US011773179B2

(12) United States Patent
Viswanathan et al.

(10) Patent No.: US 11,773,179 B2
(45) Date of Patent: Oct. 3, 2023

(54) ANTIBODY MOLECULES TO C5AR1 AND USES THEREOF

(71) Applicant: Visterra, Inc., Waltham, MA (US)

(72) Inventors: Karthik Viswanathan, Waltham, MA (US); Brian Booth, Waltham, MA (US); Boopathy Ramakrishnan, Waltham, MA (US); Andrew Wollacott, Waltham, MA (US); Gregory Babcock, Waltham, MA (US); Zachary Shriver, Waltham, MA (US)

(73) Assignee: VISTERRA, INC., Waltham, MA (US)

( * ) Notice: Subject to any disclaimer, the term of this patent is extended or adjusted under 35 U.S.C. 154(b) by 52 days.

(21) Appl. No.: 17/147,842

(22) Filed: Jan. 13, 2021

(65) Prior Publication Data

US 2022/0089764 A1 Mar. 24, 2022

Related U.S. Application Data

(60) Provisional application No. 62/960,544, filed on Jan. 13, 2020.

(51) Int. Cl.
*C07K 16/28* (2006.01)
*A61K 39/00* (2006.01)

(52) U.S. Cl.
CPC .... *C07K 16/2896* (2013.01); *A61K 2039/505* (2013.01); *C07K 2317/31* (2013.01); *C07K 2317/76* (2013.01)

(58) Field of Classification Search
CPC ............ C07K 16/2896; C07K 2317/31; C07K 2317/76; A61K 2039/505; A61P 35/00; A61P 37/00
See application file for complete search history.

(56) References Cited

U.S. PATENT DOCUMENTS

| | | | |
|---|---|---|---|
| 5,480,974 A | 1/1996 | Morgan et al. | |
| 7,317,091 B2 | 1/2008 | Lazar et al. | |
| 7,455,837 B2 | 11/2008 | Guo et al. | |
| 7,632,497 B2 | 12/2009 | Stavenhagen et al. | |
| 7,863,419 B2 | 1/2011 | Taylor et al. | |
| 8,071,096 B2 | 12/2011 | MacKay | |
| 8,071,839 B2 | 12/2011 | Mackay | |
| 8,084,024 B2 | 12/2011 | Mackay | |
| 8,084,582 B2 | 12/2011 | Dahiyat et al. | |
| 8,101,720 B2 | 1/2012 | Lazar et al. | |
| 8,124,731 B2 | 2/2012 | Lazar et al. | |
| 8,221,757 B2 | 7/2012 | MacKay | |
| 8,268,972 B2 * | 9/2012 | Whitfeld ................. | A61P 37/02 530/387.3 |
| 8,318,917 B2 | 11/2012 | Taylor et al. | |
| 8,337,852 B2 | 12/2012 | Mackay | |
| 8,361,468 B2 * | 1/2013 | Whitfeld ................. | A61P 43/00 435/343.1 |
| 8,399,618 B2 | 3/2013 | Lazar et al. | |
| 8,613,926 B2 | 12/2013 | Zahn et al. | |
| 8,673,305 B2 | 3/2014 | Mac | |
| 8,734,791 B2 | 5/2014 | Lazar et al. | |
| 8,808,701 B2 | 8/2014 | Whitfeld et al. | |
| 8,815,237 B2 | 8/2014 | Wittrup et al. | |
| 8,846,045 B2 | 9/2014 | Zahn et al. | |
| 8,940,299 B2 | 1/2015 | Medof et al. | |
| 8,952,132 B2 | 2/2015 | Georgiou et al. | |
| 8,961,967 B2 | 2/2015 | Strohl et al. | |
| 8,969,526 B2 | 3/2015 | Baehner et al. | |
| 9,180,205 B2 | 11/2015 | Zeng et al. | |
| 9,637,549 B2 | 5/2017 | Strohl et al. | |
| 9,658,236 B2 | 5/2017 | Mcknight et al. | |
| 9,683,050 B2 | 6/2017 | Zeng et al. | |
| 9,790,268 B2 | 10/2017 | Pan et al. | |
| 9,890,218 B2 | 2/2018 | Mimoto et al. | |
| 10,053,513 B2 | 8/2018 | McCarthy et al. | |
| 10,183,999 B2 | 1/2019 | Lazar et al. | |
| 10,323,097 B2 | 6/2019 | Kjaergaard et al. | |
| 10,526,408 B2 | 1/2020 | Georgiou et al. | |
| 10,590,206 B2 | 3/2020 | Labrijn et al. | |
| 10,653,791 B2 | 5/2020 | Lonberg et al. | |
| 10,836,813 B2 | 11/2020 | Pan et al. | |
| 10,882,916 B2 | 1/2021 | Kjaergaard et al. | |
| 10,894,836 B2 | 1/2021 | Stephen et al. | |
| 11,130,801 B2 | 9/2021 | Medof et al. | |
| 11,142,563 B2 | 10/2021 | Igawa et al. | |
| 2004/0132101 A1 | 7/2004 | Lazar et al. | |
| 2018/0256646 A1 | 9/2018 | Medof et al. | |
| 2018/0319877 A1 | 11/2018 | Ruike et al. | |

(Continued)

FOREIGN PATENT DOCUMENTS

| | | |
|---|---|---|
| EP | 1587540 A2 | 10/2005 |
| EP | 1443961 B1 | 5/2009 |

(Continued)

OTHER PUBLICATIONS

Kussie et al., A single engineered amino acid substitution changes antibody fine specificity, 1994, The Journal of Immunology, vol. 152, Issue 1, pp. 146-152 (Year: 1994).*
Akamizu, T. et al., "Drug-induced neutropenia associated with anti-neutrophil cytoplasmic antibodies (ANCA): possible involvement of complement in granulocyte cytotoxicity", Clinical & Experimental Immunology, vol. 127, Issu1, Jan. 2002, pp. 92-98.
Bekker, P. et al., "Characterization of Pharmacologic and Pharmacokinetic Properties of CCX168, a Potent and Selective Orally Administered Complement 5a Receptor Inhibitor, Based on Preclinical Evaluation and Randomized Phase 1 Clinical Study", y. PLoS ONE 11(10): e0164646.

(Continued)

*Primary Examiner* — Daniel E Kolker
*Assistant Examiner* — Brittney E Donoghue
(74) *Attorney, Agent, or Firm* — PROSKAUER ROSE LLP

(57) ABSTRACT

Antibody molecules that specifically bind to C5aR1 are disclosed. The antibody molecules can be used to treat, prevent, and/or diagnose disorders, such as ANCA-vasculitis.

4 Claims, 29 Drawing Sheets

Specification includes a Sequence Listing.

(56) References Cited

U.S. PATENT DOCUMENTS

| | | |
|---|---|---|
| 2019/0134020 A1 | 5/2019 | Deng et al. |
| 2019/0225708 A1 | 7/2019 | Bosteels et al. |
| 2019/0248897 A1 | 8/2019 | Ng et al. |
| 2019/0292269 A1 | 9/2019 | Monnet |
| 2019/0300621 A1 | 10/2019 | Ravetch et al. |
| 2020/0017598 A1 | 1/2020 | Andersson et al. |
| 2020/0095310 A1 | 3/2020 | Regula et al. |
| 2020/0131253 A1 | 4/2020 | Parren et al. |
| 2020/0148779 A1 | 5/2020 | Yamniuk et al. |
| 2020/0181257 A1 | 6/2020 | Kuramochi et al. |
| 2020/0199241 A1 | 6/2020 | Igawa et al. |
| 2020/0247897 A1 | 8/2020 | Jensen et al. |
| 2020/0299400 A1 | 9/2020 | Lonberg et al. |
| 2020/0316171 A1 | 10/2020 | Pandey |
| 2020/0332022 A1 | 10/2020 | Labrijn et al. |
| 2020/0376135 A1 | 12/2020 | Boitano et al. |
| 2021/0070860 A1 | 3/2021 | Marasco et al. |
| 2021/0238300 A1 | 8/2021 | Kjaergaard et al. |
| 2021/0261648 A1 | 8/2021 | Katada et al. |
| 2021/0285964 A1 | 9/2021 | Mcknight et al. |
| 2022/0356263 A1* | 11/2022 | Viswanathan ..... C07K 16/2896 |

FOREIGN PATENT DOCUMENTS

| | | |
|---|---|---|
| EP | 1706424 B1 | 7/2009 |
| EP | 1701611 B1 | 5/2011 |
| EP | 1476469 B1 | 11/2015 |
| EP | 2345671 B1 | 11/2015 |
| EP | 2940043 A1 | 11/2015 |
| EP | 2994488 A1 | 3/2016 |
| EP | 2506871 B1 | 10/2016 |
| EP | 2552955 B1 | 5/2017 |
| EP | 2673299 B1 | 5/2017 |
| EP | 2371861 B1 | 8/2017 |
| EP | 2486141 B1 | 1/2018 |
| EP | 2691417 B1 | 8/2018 |
| EP | 2718322 B1 | 8/2018 |
| EP | 3004174 B1 | 4/2019 |
| EP | 2844289 B1 | 7/2019 |
| EP | 3141260 B1 | 8/2019 |
| EP | 3541837 A1 | 9/2019 |
| EP | 3576793 A1 | 12/2019 |
| EP | 2943507 B1 | 2/2020 |
| EP | 3608339 A1 | 2/2020 |
| EP | 3630832 A1 | 4/2020 |
| EP | 3630833 A1 | 4/2020 |
| EP | 3424953 B1 | 8/2020 |
| EP | 2698431 B1 | 9/2020 |
| EP | 3768315 A1 | 1/2021 |
| EP | 3411400 B1 | 9/2021 |
| WO | WO 2004/082568 A3 | 9/2004 |
| WO | WO 2005/050199 A1 | 6/2005 |
| WO | WO 2008/022390 A1 | 2/2008 |
| WO | WO-2011100477 A2 * | 8/2011 ............ C07K 16/00 |
| WO | WO 2012/168199 A1 | 12/2012 |
| WO | WO 2018/065389 A1 | 3/2018 |
| WO | WO 2018/145075 A1 | 8/2018 |
| WO | WO 2018/183520 A1 | 10/2018 |
| WO | WO 2018/217988 A9 | 11/2018 |
| WO | WO 2018/218056 A1 | 11/2018 |
| WO | WO 2018/224609 A1 | 12/2018 |
| WO | WO 2018/234118 A1 | 12/2018 |
| WO | WO 2019/125846 A1 | 6/2019 |
| WO | WO 2019/183362 A1 | 9/2019 |
| WO | WO 2020/112781 A1 | 6/2020 |
| WO | WO-2020/182974 A1 | 9/2020 |
| WO | WO 2021/041715 A2 | 3/2021 |
| WO | WO-2021/146320 A1 | 7/2021 |
| WO | WO 2021/180063 A1 | 9/2021 |
| WO | WO 2021/190770 A1 | 9/2021 |

OTHER PUBLICATIONS

Grayson, P. et al., "Antineutrophil Cytoplasmic Antibodies, Autoimmune Neutropenia, and Vasculitis", Seminars in Arthritis and Rheumatism, vol. 42, Issue 3, Dec. 2011, pp. 424-433.

International Search Report for PCT/US2021/013284, 5 pages (dated May 4, 2021).

Knight, A. et al., "Late-onset neutropenia after rituximab in ANCA-associated vasculitis", Scandinavian Journal of Rheumatology, vol. 45, Issue 5, 2016.

La-Crette, J. et al., "Long-term outcomes of daily oral vs. pulsed intravenous cyclophosphamide in a non-trial setting in ANCA-associated vasculitis", Clin Rheumatol. 2018; 37(4): 1085-1090.

Melis, J. et al., "Complement in therapy and disease: Regulating the complement system with antibody-based therapeutics", Molecular Immunology, Vo. 67, No. 2, Part A, Oct. 2015, pp. 117-130.

Ohlsson, S. et al., "Neutrophils from ANCA-associated vasculitis patients show an increased capacity to activate the complement system via the alternative pathway after ANCA stimulation", PLoS ONE 14(6): e0218272.

Anliker-Ort et al., "Treatment of Rare Inflammatory Kidney Diseases: Drugs Targeting the Terminal Complement Pathway", Frontiers of Immunology, vol. 11, Dec. 10, 2020.

Huang et al, "Discovery of human antibodies against the C5aR target using phage display technology", Journal of Molecular Recognition, vol. 18, No. 4, Jun. 1, 2005, pp. 327-333 (7 pages).

International Search Report and Written Opinion for PCT/US2022/012317 dated Jun. 17, 2022 (21 pages).

Rudikoff et al., "Single amino acid substitution altering antigen-binding specificity", Proceedings of the National Academy of Sciences, vol. 79, No. 6, Mar. 1, 1982, pp. 1979-1983 (5 pages).

* cited by examiner

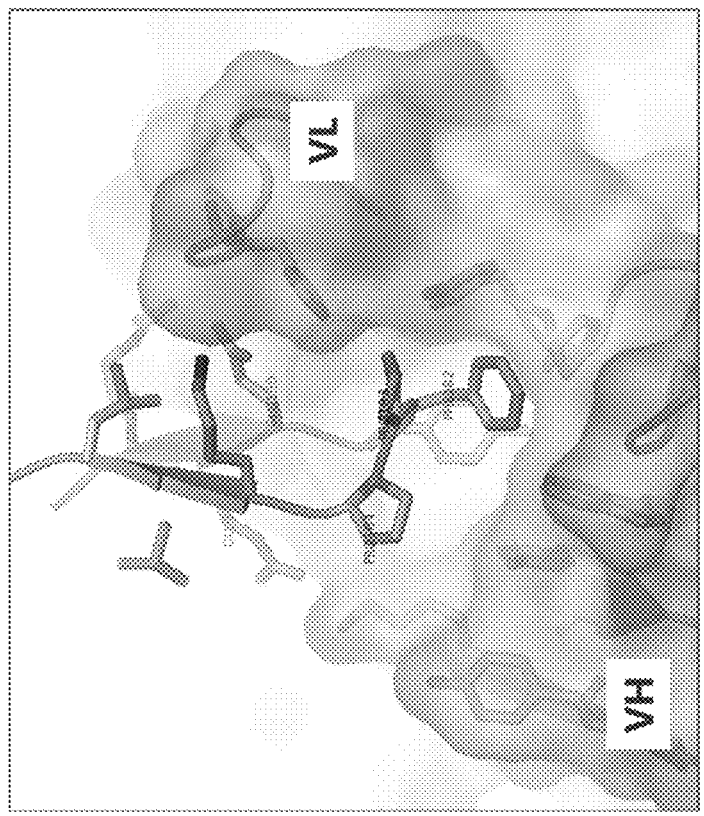
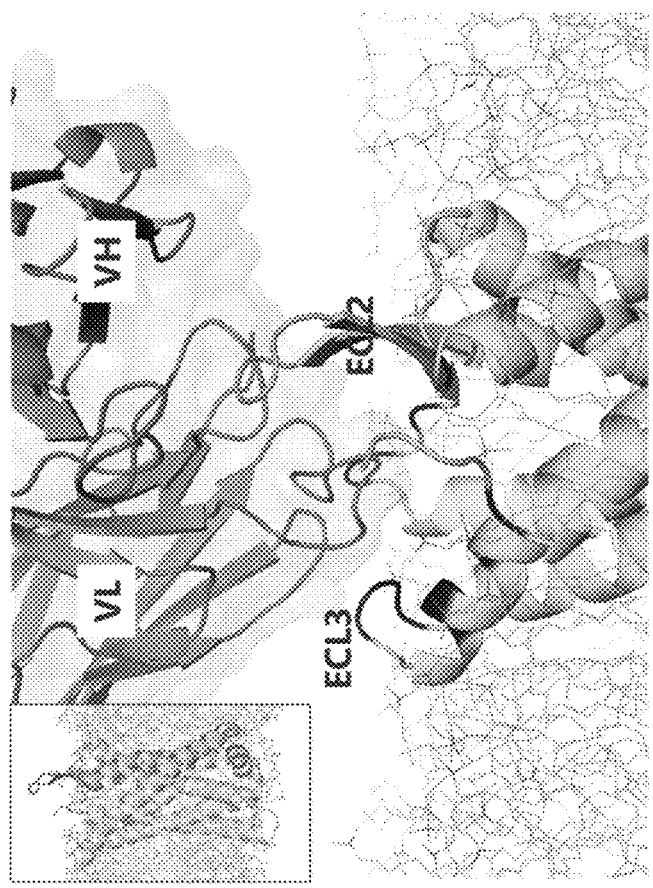
FIG. 4B
FIG. 4A

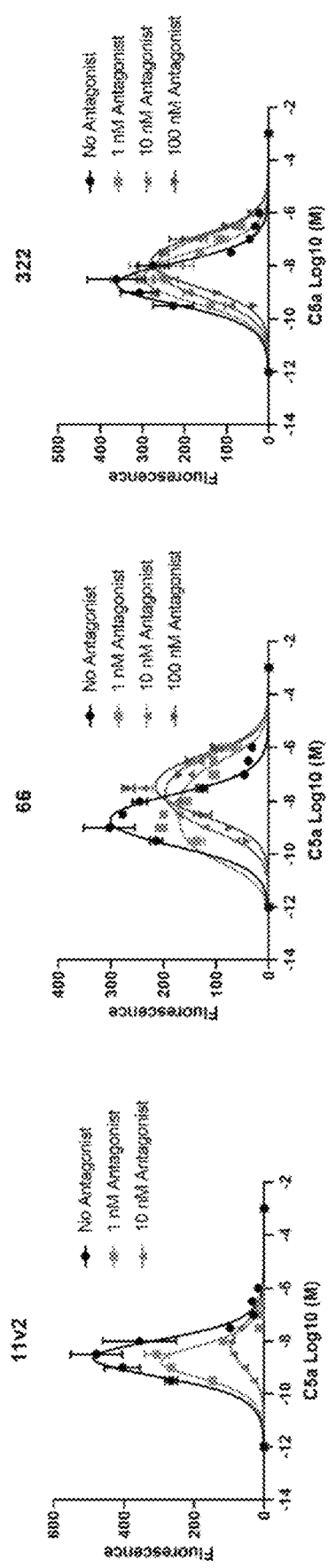
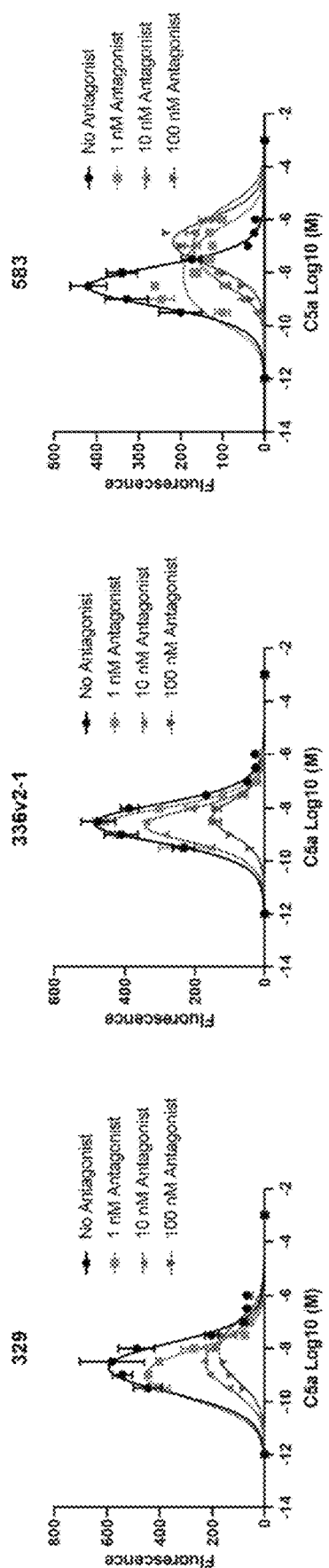
FIG. 8A, FIG. 8B, FIG. 8C, FIG. 8D, FIG. 8E, FIG. 8F

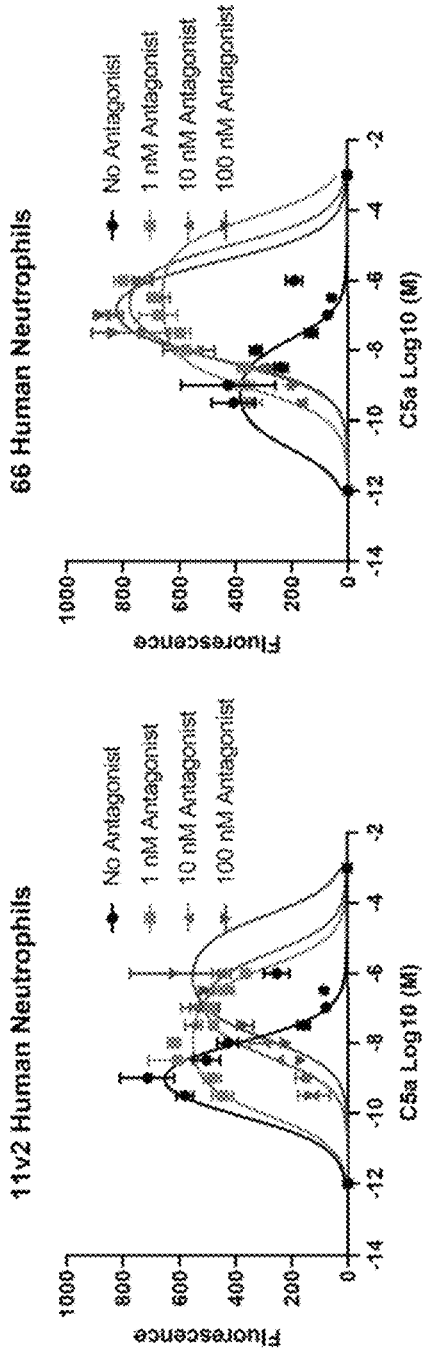
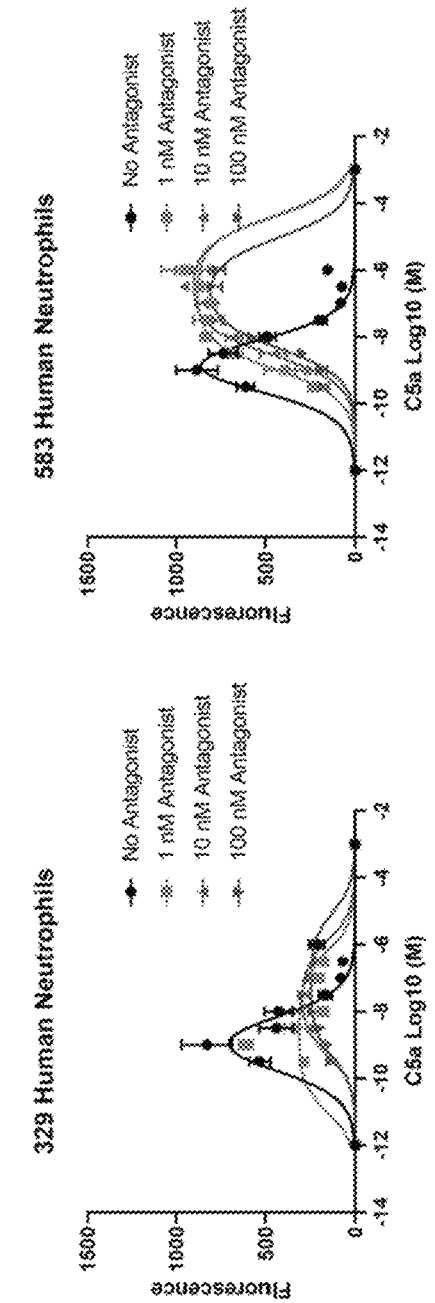
FIG. 9A
FIG. 9B
FIG. 9C
FIG. 9D

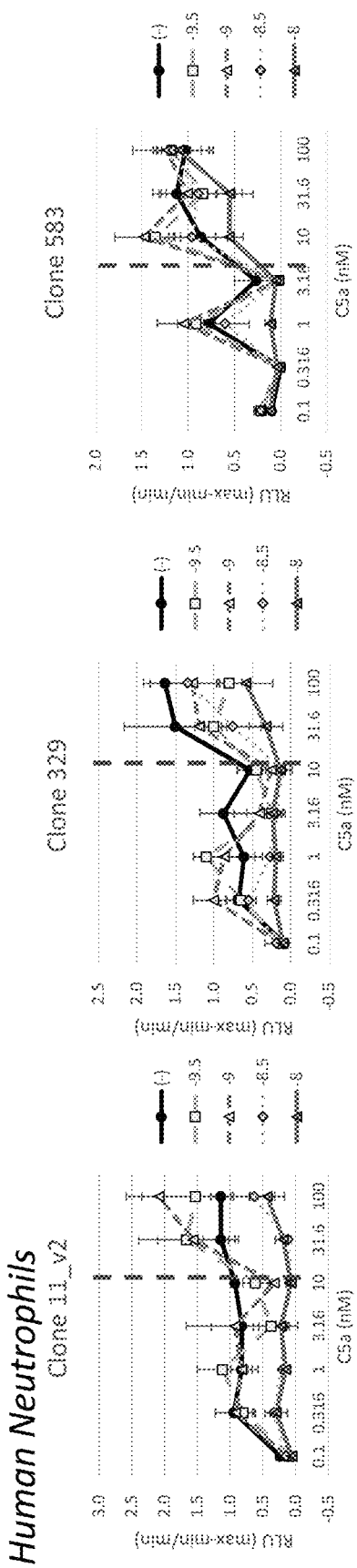

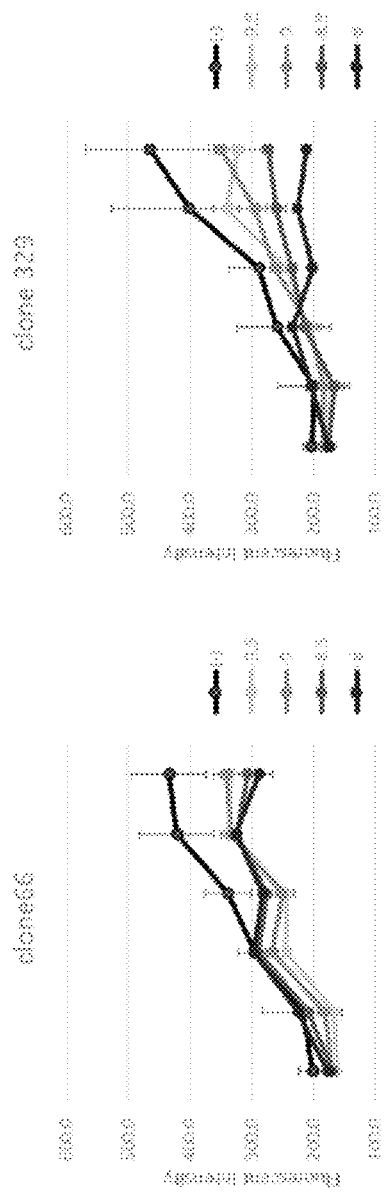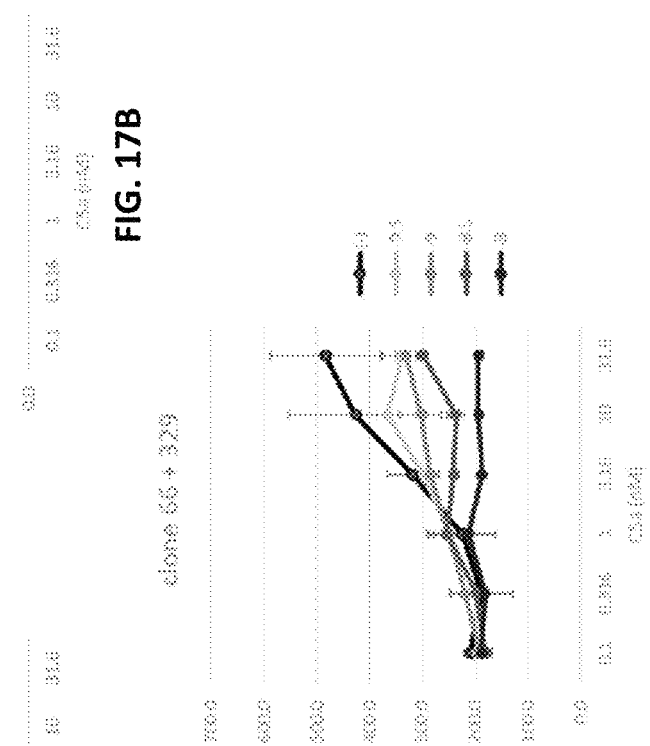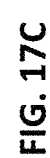
FIG. 17A
FIG. 17B
FIG. 17C

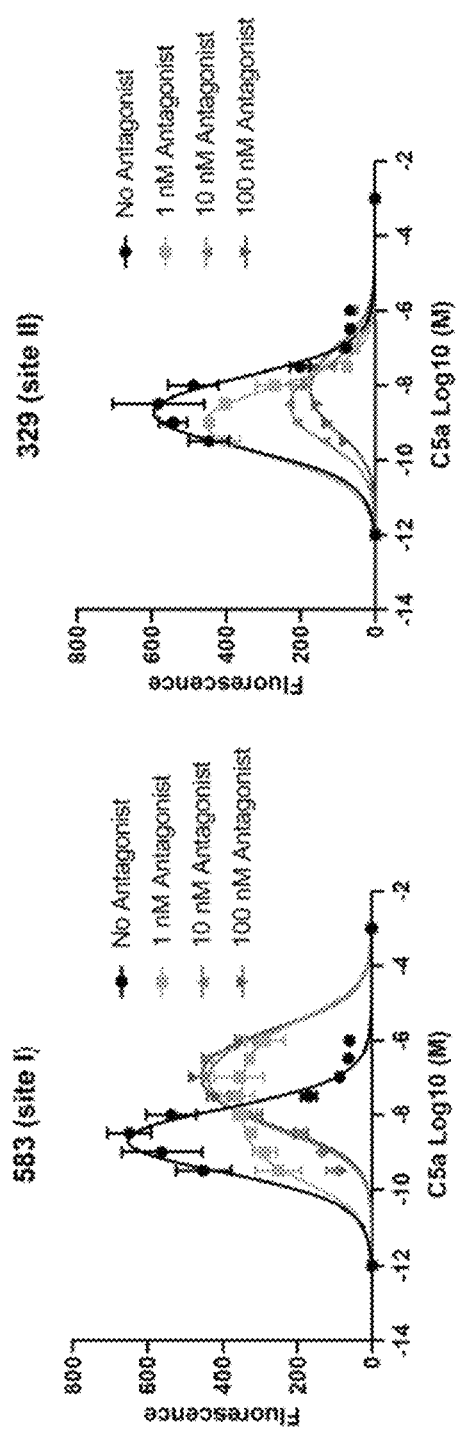
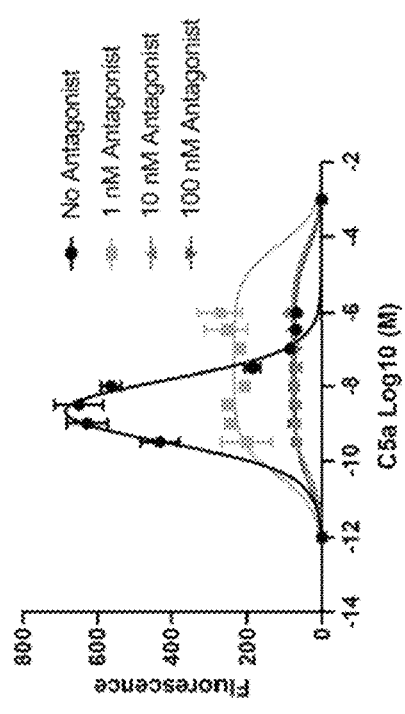
FIG. 18A
FIG. 18B
FIG. 18C

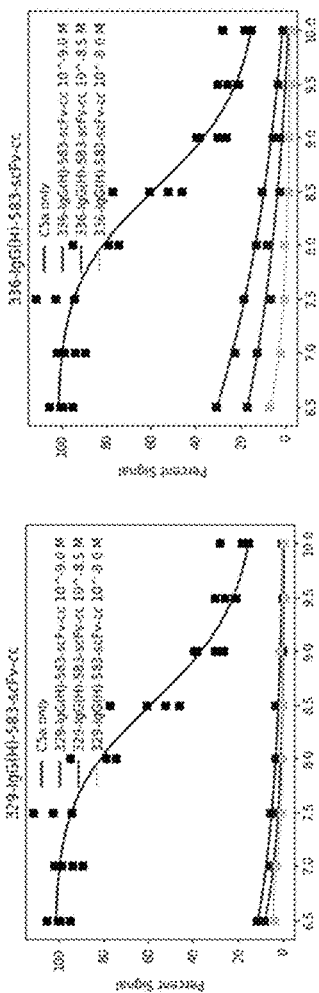
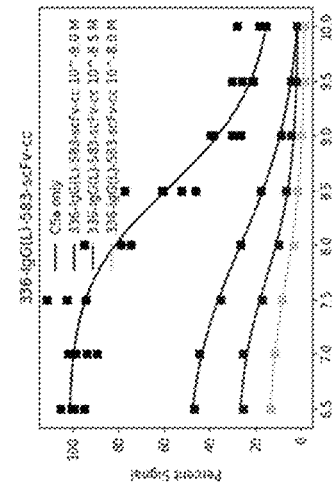
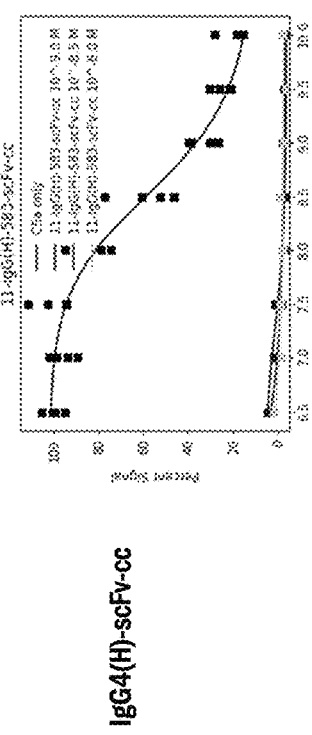
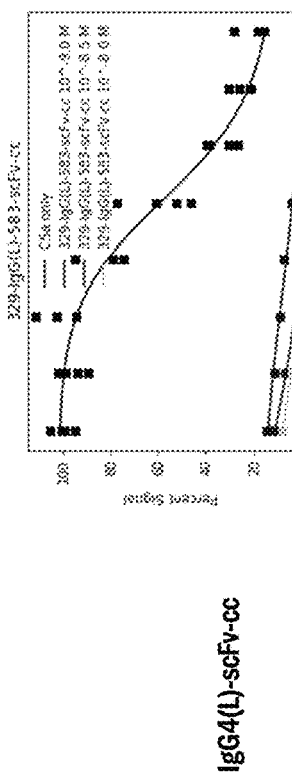
FIG. 19A, FIG. 19B, FIG. 19C, FIG. 19D, FIG. 19E

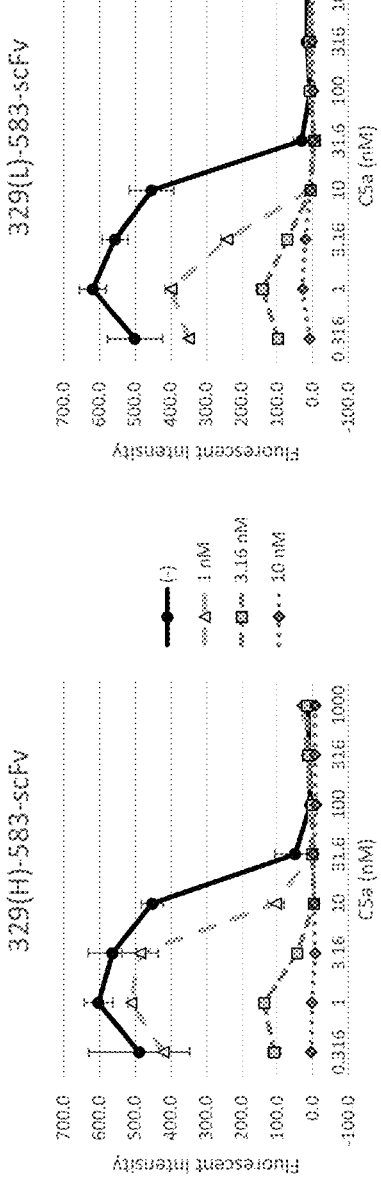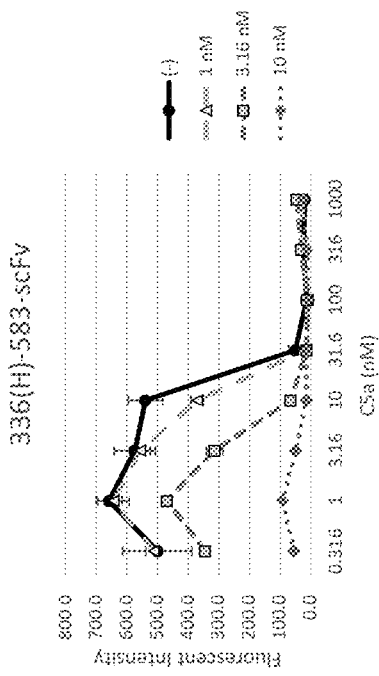

ANTIBODY MOLECULES TO C5AR1 AND USES THEREOF

CROSS-REFERENCE TO RELATED APPLICATIONS

The present application is a claims priority to U.S. Provisional Application Ser. No. 62/960,544 filed Jan. 13, 2020, the disclosure of which is hereby incorporated by reference in its entirety.

INCORPORATION-BY-REFERENCE-OF SEQUENCE LISTING

The contents of the file named "SVI-001US_ST25.txt", which was created on Apr. 7, 2021 and is 707 KB in size, are hereby incorporated by reference in their entirety.

BACKGROUND

Anti-neutrophil cytoplasmic autoantibody (ANCA)-associated vasculitis (AAV) is an autoimmune disease characterized by inflammation and destruction of small- and medium-sized blood vessels and the presence of circulating antibodies against myeloperoxidase (MPO-ANCA) or proteinase 3 (PR3-ANCA). AAV affects various organs, but most commonly the kidney, with >75% of patients characterized by rapidly progressive glomerulonephritis. The potent anaphylatoxin, complement component 5a (C5a), promotes chemotaxis and activation of neutrophils, a key driver in inflammatory diseases driven by type III hypersensitivities such as ANCA-vasculitis.

There is a need for developing new approaches for treating, preventing and diagnosing various disorders associated with C5 and its receptors, e.g., complement 5 receptor 1 (C5aR1), including ANCA-vasculitis and other disorders that share similar disease mechanisms.

SUMMARY

The present invention provides, among other things, anti-C5aR1 antibodies with increased specificity to C5aR1 and therapeutic uses of such antibodies in effectively treating diseases or disorders associated with C5 and its receptors, such as, ANCA-vasculitis, COVID-19, Acute respiratory distress syndrome (ARDS), Influenza A, typical hemolytic uremic syndrome, age-related macular degeneration, rheumatoid arthritis, sepsis, severe burn, antiphospho lipid syndrome, asthma, lupus nephritis, Goodpasture's syndrome, and chronic obstructive pulmonary disease. As described herein, the present invention is, in part, based on identification of a new class of anti-C5aR1 specific antibodies that bind to certain regions on Site I and/or Site II of C5aR1 and have significantly reduced cross reactivity to C5aR2 or any other G protein-coupled receptors. In particular, anti-C5aR1 antibodies of the present invention are characterized with high binding affinity to C5aR1 (e.g., with $K_D$ less than 50 nM) and minimal cross-reactivity with C5aR2. This is significant because C5aR1-antibodies of the present invention allow potent inhibition of C5aR1 signaling in the presence of high C5a concentrations. As a result, C5aR1-antibodies of the present invention can be used at a lower dose to achieve therapeutic effect relative to the other anti-C5aR1 antibodies or C5a-antibodies. This is demonstrated by the surprisingly high potency observed in functional assays, relative to prior-art antibodies, as described herein. Moreover, highly potent Site I C5aR1 antibodies of the present invention compete with each other for Site I, and highly potent Site II C5aR1 antibodies of the present invention compete with each other on Site II. Additionally, the present invention provides methods and compositions for inhibiting C5aR1 and/or C5a signaling by targeting both Site I and Site II of C5aR1. Simultaneous targeting of Site I and Site II significantly enhances inhibitory activity. For example, combination of Site I and Site II antibodies or bispecific antibodies (e.g., biparatopic), but not two Site II or two Site II antibodies, significantly enhance activity. Inventive anti-C5aR1 antibodies of the present invention promise a more potent treatment of complement mediated diseases and disorders, particularly ANCA-vasculitis.

The C5a-C5aR1 axis is of particular interest for therapeutic intervention in order to block attraction of neutrophils to local sites, inhibit neutrophil activation as well as vascular destruction. The compositions and methods disclosed herein, may include a step of administering a C5aR1 antagonist, as well as methods of treating a subject in need of such a treatment In one aspect, described herein is an antibody molecule capable of binding to complement component of 5a receptor 1 (C5aR1), comprising a heavy chain variable region (VH) having a sequence disclosed herein and/or a light chain variable region (VL) having a sequence disclosed herein.

In one aspect, described herein is an antibody molecule capable of binding to complement component of 5a receptor 1 (C5aR1), comprising a heavy chain variable region (VH) and/or a light chain variable region (VL), wherein the VH comprises an HCDR1, an HCDR2, and an HCDR3, each of which differs by no more than 1, 2, 3 amino acid residues from, or has at least 85, 90, 95, 99 or 100% identity with the HCDR1, HCDR2, and HCDR3, respectively, of a VH described in Table 2A, and/or wherein the VL comprises an LCDR1, an LCDR2, and an LCDR3, each of which differs by no more than 1, 2, or 3 amino acid residues from, or has at least 85, 90, 95, 99 or 100% identity with, the LCDR1, LCDR2, and LCDR3, respectively, of a VL described in Table 2B.

In some embodiments, a VH comprises an HCDR1, an HCDR2, and an HCDR3, each of which differs by no more than 1, 2, 3 amino acid residues from, or has at least 85, 90, 95, 99 or 100% identity with the HCDR1, HCDR2, and HCDR3, respectively, of a VH described in Table 1A.

In some embodiments, a VH comprises an HCDR1, an HCDR2, and an HCDR3, each of which differs by no more than 1, 2, 3 amino acid residues from, or has at least 85, 90, 95, 99 or 100% identity with the HCDR1, HCDR2, and HCDR3, respectively, of a VH described in Table 3A.

In some embodiments, a VL comprises an LCDR1, an LCDR2, and an LCDR3, each of which differs by no more than 1, 2, or 3 amino acid residues from, or has at least 85, 90, 95, 99 or 100% identity with, the LCDR1, LCDR2, and LCDR3, respectively, of a VL described in Table 1B.

In some embodiments, a VL comprises an LCDR1, an LCDR2, and an LCDR3, each of which differs by no more than 1, 2, or 3 amino acid residues from, or has at least 85, 90, 95, 99 or 100% identity with, the LCDR1, LCDR2, and LCDR3, respectively, of a VL described in Table 3B In one aspect, described herein is an antibody molecule capable of binding to C5aR1 (e.g., human C5aR1), comprising a VH and/or a VL, wherein the VH comprises (i) an HCDR1 comprises an amino acid sequence that differs by no more than 1, 2, or 3 amino acid residues from, or has at least 85, 90, 95, 99 or 100% identity with, the amino acid sequence of any of SEQ ID NOs: 601-661; (ii) an HCDR2 comprises an amino acid sequence that differs by no more than 1, 2, or 3 amino acid residues from, or has at least 85, 90, 95, 99 or 100% identity with the amino acid sequence of any of SEQ ID NOs: 721-781; and/or (iii) an HCDR3 comprises an amino acid sequence that differs by no more than 1, 2, or 3 amino acid residues from, or has at least 85, 90, 95, 99 or 100% identity with the amino acid sequence of any of SEQ ID NOs: 841-901; and/or wherein the VL comprises: (i) an LCDR1 comprising an amino acid sequence that differs by no more than 1, 2, or 3 amino acid residues from, or has at least 85, 90, 95, 99 or 100% identity with the amino acid sequence of any of SEQ ID NOs: 662-720, an LCDR2 comprising an amino acid sequence that differs by no more than 1, 2, or 3 amino acid residues from, or has at least 85, 90, 95, 99 or 100% identity with the amino acid sequence of any of SEQ ID NOs: 782-840, and/or (iii) an LCDR3 comprising an amino acid sequence that differs by no more than 1, 2, or 3 amino acid residues from, or has at least 85, 90, 95, 99 or 100% identity with the amino acid sequence of any of SEQ ID NOs: 902-960.

In one aspect, described herein is an antibody molecule capable of binding to complement component 5a receptor 1 (C5aR1), wherein the antibody molecule competes with a C5aR1 antibody molecule comprising a HCDR1 comprising an amino acid sequence of SEQ ID NO: 656, a HCDR2 comprising an amino acid sequence of SEQ ID NO: 776, and a HCDR3 comprising and amino acid sequence of SEQ ID NO: 896, a LCDR1 comprising an amino acid sequence of SEQ ID NO: 715, a LCDR2 comprising an amino acid sequence of SEQ ID NO: 835, and a LCDR3 comprising an amino acid sequence of SEQ ID NO: 955.

In one aspect, the present invention provides, among other things, an antibody molecule capable of binding to complement component 5a receptor 1 (C5aR1), wherein the antibody molecule comprises a VH and/or a VH, wherein the VH comprises an HCDR1 comprising an amino acid sequence of SEQ ID NO: 1456, a HCDR2 comprising an amino acid sequence of SEQ ID NO: 1457, and a HCDR3 comprising and amino acid sequence of SEQ ID NO: 1458, a LCDR1 comprising an amino acid sequence of SEQ ID NO: 1459, a LCDR2 comprising an amino acid sequence of SEQ ID NO: 1460, and a LCDR3 comprising an amino acid sequence of SEQ ID NO: 1461.

In some embodiments, an antibody molecule capable of binding to complement component 5a receptor 1 (C5aR1) competes with a C5aR1 antibody molecule comprising a HCDR1 comprising an amino acid sequence of SEQ ID NO: 656, a HCDR2 comprising an amino acid sequence of SEQ ID NO: 776, and a HCDR3 comprising and amino acid sequence of SEQ ID NO: 896.

In some embodiments, an antibody molecule capable of binding to complement component 5a receptor 1 (C5aR1) competes with a C5aR1 antibody molecule comprising a LCDR1 comprising an amino acid sequence of SEQ ID NO: 715, a LCDR2 comprising an amino acid sequence of SEQ ID NO: 835, and a LCDR3 comprising an amino acid sequence of SEQ ID NO: 955.

In one aspect, described herein is an antibody molecule capable of binding to complement component 5a receptor 1 (C5aR1), wherein the antibody molecule binds to an epitope on Site I of C5aR1, wherein the epitope on Site I comprises amino acid residues of SEQ ID NO: 1449 or SEQ ID NO: 1452.

In some embodiments, the antibody molecule binds to amino acid residues T8-D18 in SEQ ID NO: 1449 or SEQ ID NO: 1452.

In some embodiments, the antibody molecule binds to amino acid residues T8-G12 in SEQ ID NO: 1449 or SEQ ID NO: 1452.

In some embodiments, the antibody molecule to amino acid residues T8, D10, Y11, Y14, and/or D15 in SEQ ID NO: 1449 or SEQ ID NO: 1452.

In one aspect, described herein is an antibody molecule capable of binding to complement component 5a receptor 1 (C5aR1), comprising a heavy chain variable region (VH) and a light chain variable region (VL), wherein the VH has at least 80% identity with the amino acid sequence of any of SEQ ID NOs: 481-541; and wherein the VL has at least 70% identity with the amino acid sequence of any of SEQ ID NOs: 542-600.

In some embodiments, an antibody molecule comprises a heavy chain variable region (VH) has at least 75% identity with the amino acid sequence of any of SEQ ID NO: 481-541. In some embodiments, an antibody molecule comprises a heavy chain variable region (VH) has at least 78% identity with the amino acid sequence of any of SEQ ID NO: 481-541. In some embodiments, an antibody molecule comprises a heavy chain variable region (VH) has at least 80% identity with the amino acid sequence of any of SEQ ID NO: 481-541. In some embodiments, an antibody molecule comprises a heavy chain variable region (VH) has at least 82% identity with the amino acid sequence of any of SEQ ID NO: 481-541. In some embodiments, an antibody molecule comprises a heavy chain variable region (VH) has at least 85% identity with the amino acid sequence of any of SEQ ID NO: 481-541. In some embodiments, an antibody molecule comprises a heavy chain variable region (VH) has at least 87% identity with the amino acid sequence of any of SEQ ID NO: 481-541. In some embodiments, an antibody molecule comprises a heavy chain variable region (VH) has at least 90% identity with the amino acid sequence of any of SEQ ID NO: 481-541. In some embodiments, an antibody molecule comprises a heavy chain variable region (VH) has at least 92% identity with the amino acid sequence of any of SEQ ID NO: 481-541. In some embodiments, an antibody molecule comprises a heavy chain variable region (VH) has at least 95% identity with the amino acid sequence of any of SEQ ID NO: 481-541. In some embodiments, an antibody molecule comprises a heavy chain variable region (VH) has at least 97% identity with the amino acid sequence of any of SEQ ID NO: 481-541. In some embodiments, an antibody molecule comprises a heavy chain variable region (VH) has at least 98% identity with the amino acid sequence of any of SEQ ID NO: 481-541. In some embodiments, an antibody molecule comprises a heavy chain variable region (VH) has at least 99% identity with the amino acid sequence of any of SEQ ID NO: 481-541. In some embodiments, an antibody molecule comprises a heavy chain variable region (VH) has 100% identity with the amino acid sequence of any of SEQ ID NO: 481-541.

In some embodiments, an antibody molecule comprises a light chain variable region (VH) has at least 68% identity with the amino acid sequence of any of SEQ ID NO: 542-600. In some embodiments, an antibody molecule comprises a light chain variable region (VH) has at least 70% identity with the amino acid sequence of any of SEQ ID NO: 542-600. In some embodiments, an antibody molecule comprises a light chain variable region (VH) has at least 72% identity with the amino acid sequence of any of SEQ ID NO: 542-600. In some embodiments, an antibody molecule comprises a light chain variable region (VH) has at least 75% identity with the amino acid sequence of any of SEQ ID NO: 542-600. In some embodiments, an antibody molecule comprises a light chain variable region (VL) has at least 78% identity with the amino acid sequence of any of SEQ ID NO: 542-600. In some embodiments, an antibody molecule comprises a light chain variable region (VL) has at least 80% identity with the amino acid sequence of any of SEQ ID NO: 542-600. In some embodiments, an antibody molecule comprises a light chain variable region (VL) has at least 82% identity with the amino acid sequence of any of SEQ ID NO: 542-600. In some embodiments, an antibody molecule comprises a light chain variable region (VL) has at least 85% identity with the amino acid sequence of any of SEQ ID NO: 542-600. In some embodiments, an antibody molecule comprises a light chain variable region (VL) has at least 87% identity with the amino acid sequence of any of SEQ ID NO: 542-600. In some embodiments, an antibody molecule comprises a light chain variable region (VL) has at least 90% identity with the amino acid sequence of any of SEQ ID NO: 542-600. In some embodiments, an antibody molecule comprises a light chain variable region (VL) has at least 92% identity with the amino acid sequence of any of SEQ ID NO: 542-600. In some embodiments, an antibody molecule comprises a light chain variable region (VL) has at least 95% identity with the amino acid sequence of any of SEQ ID NO: 542-600. In some embodiments, an antibody molecule comprises a light chain variable region (VL) has at least 97% identity with the amino acid sequence of any of SEQ ID NO: 542-600. In some embodiments, an antibody molecule comprises a light chain variable region (VL) has at least 98% identity with the amino acid sequence of any of SEQ ID NO: 542-600. In some embodiments, an antibody molecule comprises a light chain variable region (VL) has at least 99% identity with the amino acid sequence of any of SEQ ID NO: 542-600. In some embodiments, an antibody molecule comprises a light chain variable region (VL) has 100% identity with the amino acid sequence of any of SEQ ID NO: 542-600.

In one aspect, described herein is an antibody molecule capable of binding to complement component 5a receptor 1 (C5aR1), comprising a VH and/or a VL, wherein the VH comprises: an HCDR1 comprising an amino acid sequence of SEQ ID NO: 656; an HCDR2 comprising an amino acid sequence of SEQ ID NO: 776; and an HCDR3 comprising an amino acid sequence of SEQ ID NO: 896; and wherein the VL comprises: an LCDR1 comprising an amino acid sequence of SEQ ID NO: 715, an LCDR2 comprising an amino acid sequence of SEQ ID NO: 835, and an LCDR3 comprising an amino acid sequence of SEQ ID NO: 955.

In one aspect, described herein is an antibody molecule capable of to complement component 5a receptor 1 (C5aR1), comprising a VH and/or a VL, wherein the VH comprises an amino acid sequence with at least 80% identity with amino acid sequence of SEQ ID NO: 536; and wherein the VL comprises an amino acid sequence with at least 70% identity with amino acid sequence of SEQ ID NO: 595.

In one embodiment, the antibody molecule comprises the VH comprising the amino acid sequence of SEQ ID NO: 536 and the VL comprises the amino acid sequence of SEQ ID NO: 595.

In one aspect, the present invention provides, among other things, an antibody molecule capable of binding to complement component 5a receptor 1 (C5aR1), wherein the antibody molecule comprises a VH and/or a VH, wherein the VH comprises an HCDR1 comprising an amino acid sequence of SEQ ID NO: 1462, a HCDR2 comprising an amino acid sequence of SEQ ID NO: 1463, and a HCDR3 comprising and amino acid sequence of SEQ ID NO: 1464, a LCDR1 comprising an amino acid sequence of SEQ ID NO: 1465, a LCDR2 comprising an amino acid sequence of SEQ ID NO: 1466, and a LCDR3 comprising an amino acid sequence of SEQ ID NO: 1467.

In one aspect, described herein is an antibody molecule capable of binding to complement component 5a receptor 1 (C5aR1), comprising a VH and/or a VL, wherein the VH comprises: an HCDR1 comprising an amino acid sequence of SEQ ID NO: 603; an HCDR2 comprising an amino acid sequence of SEQ ID NO: 723; and an HCDR3 comprising an amino acid sequence of SEQ ID NO: 843; and wherein the VL comprises: an LCDR1 comprising an amino acid sequence of SEQ ID NO: 663, an LCDR2 comprising an amino acid sequence of SEQ ID NO: 783, and an LCDR3 comprising an amino acid sequence of SEQ ID NO: 903.

In one embodiment, the antibody molecule comprises the VH comprising the amino acid sequence of SEQ ID NO: 483 and the VL comprises the amino acid sequence of SEQ ID NO: 543.

In one aspect, described herein is an antibody molecule capable of binding to complement component 5a receptor 1 (C5aR1), comprising a VH and/or a VL, wherein the VH comprises: an HCDR1 comprising an amino acid sequence of SEQ ID NO: 611; an HCDR2 comprising an amino acid sequence of SEQ ID NO: 731; and an HCDR3 comprising an amino acid sequence of SEQ ID NO: 851; and wherein the VL comprises: an LCDR1 comprising an amino acid sequence of SEQ ID NO: 671, an LCDR2 comprising an amino acid sequence of SEQ ID NO: 792, and an LCDR3 comprising an amino acid sequence of SEQ ID NO: 911.

In some embodiments, the antibody molecule comprises the VH comprising the amino acid sequence of SEQ ID NO: 491 and the VL comprises the amino acid sequence of SEQ ID NO: 551.

In one aspect, described herein is an antibody molecule capable of binding to complement component 5a receptor 1 (C5aR1), wherein the antibody molecule competes with a C5aR1 antibody molecule comprising: an HCDR1 comprising an amino acid sequence of SEQ ID NO: 612, an HCDR2 comprising an amino acid sequence of SEQ ID NO: 732, and an HCDR3 comprising and amino acid sequence of SEQ ID NO: 852, an LCDR1 comprising an amino acid sequence of SEQ ID NO: 672, an LCDR2 comprising an amino acid sequence of SEQ ID NO: 792, and an LCDR3 comprising an amino acid sequence of SEQ ID NO: 912.

In one aspect, described herein is an antibody molecule capable of binding to complement component 5a receptor 1 (C5aR1), wherein the antibody molecule binds to an epitope on Site II of C5aR1, wherein the epitope on Site II comprises amino residues of SEQ ID NO: 1450.

In some embodiments, the antibody molecule binds to amino acid residues R175-G189 in SEQ ID NO: 1448.

In some embodiments, the antibody molecule binds to amino acid residues E180-P183 in SEQ ID NO: 1448.

In some embodiments, the antibody molecule binds to amino acid residues E180-P184 in SEQ ID NO: 1448.

In some embodiments, wherein the antibody molecule binds to amino acid residues E178-P183 in SEQ ID NO: 1448.

In one aspect, described herein is an antibody molecule capable of binding to complement component 5a receptor 1 (C5aR1), comprising a VH and/or a VL, wherein the VH comprises: an HCDR1 comprising an amino acid sequence of SEQ ID NO: 612; an HCDR2 comprising an amino acid sequence of SEQ ID NO: 732; and an HCDR3 comprising an amino acid sequence of SEQ ID NO: 852; and wherein the VL comprises: an LCDR1 comprising an amino acid sequence of SEQ ID NO: 672, an LCDR2 comprising an amino acid sequence of SEQ ID NO: 792, and an LCDR3 comprising an amino acid sequence of SEQ ID NO: 912.

In one aspect, described herein is an antibody molecule capable of binding to complement component 5a receptor 1 (C5aR1), comprising a VH and/or a VL, wherein the VH comprises: an HCDR1 comprising amino acid sequence that differs no more than 1 or 2 amino acid residues from SEQ ID NO: 612; an HCDR2 comprising amino acid sequence that differs no more than 1 or 2 amino acid residues from SEQ ID NO: 732; and an HCDR3 comprising amino acid sequence that differs no more than 1 or 2 amino acid residues from SEQ ID NO: 852; and wherein the VL comprises: an LCDR1 comprising amino acid sequence that differs no more than 1 or 2 amino acid residues from SEQ ID NO: 672, an LCDR2 comprising amino acid sequence that differs no more than 1 or 2 amino acid residues from SEQ ID NO: 792, and an LCDR3 comprising amino acid sequence that differs no more than 1 or 2 amino acid residues from of SEQ ID NO: 912.

In one aspect, described herein is an antibody molecule capable of to complement component 5a receptor 1 (C5aR1), comprising a VH and/or a VL, wherein the VH comprises an amino acid sequence with at least 80% identity with amino acid sequence of SEQ ID NO: 492; and wherein the VL comprises an amino acid sequence with at least 70% identity with amino acid sequence of SEQ ID NO: 552.

In some embodiments, the antibody molecule comprises the VH comprising the amino acid sequence of SEQ ID NO: 492 and the VL comprises the amino acid sequence of SEQ ID NO: 552.

In one aspect, described herein is an antibody molecule capable of binding to complement component 5a receptor 1 (C5aR1), comprising a VH and/or a VL, wherein the VH comprises: an HCDR1 comprising an amino acid sequence of SEQ ID NO: 602; an HCDR2 comprising an amino acid sequence of SEQ ID NO: 722; and an HCDR3 comprising an amino acid sequence of SEQ ID NO: 842; and wherein the VL comprises: an LCDR1 comprising an amino acid sequence of SEQ ID NO: 662, an LCDR2 comprising an amino acid sequence of SEQ ID NO: 782, and an LCDR3 comprising an amino acid sequence of SEQ ID NO: 902.

In some embodiments, the antibody molecule comprises the VH comprising the amino acid sequence of SEQ ID NO: 482 and the VL comprises the amino acid sequence of SEQ ID NO: 542.

In one aspect, described herein is an antibody molecule capable of binding to complement component 5a receptor 1 (C5aR1), comprising a VH and/or a VL, wherein the VH comprises: an HCDR1 comprising an amino acid sequence of SEQ ID NO: 617; an HCDR2 comprising an amino acid sequence of SEQ ID NO: 737; and an HCDR3 comprising an amino acid sequence of SEQ ID NO: 857; and wherein the VL comprises: an LCDR1 comprising an amino acid sequence of SEQ ID NO: 677, an LCDR2 comprising an amino acid sequence of SEQ ID NO: 797, and an LCDR3 comprising an amino acid sequence of SEQ ID NO: 917.

In some embodiments, the antibody molecule comprises the VH comprising the amino acid sequence of SEQ ID NO: 497 and the VL comprises the amino acid sequence of SEQ ID NO: 557.

In some embodiments, the antibody molecule reduces (e.g., inhibits or blocks) localized enrichment of C5a to C5aR1.

In some embodiments, the antibody molecule binds to C5aR1 with a dissociation constant ($K_D$) of less than about 100 nM. In some embodiments, the antibody molecule binds to C5aR1 with a dissociation constant ($K_D$) of less than about 90 nM. In some embodiments, the antibody molecule binds to C5aR1 with a dissociation constant ($K_D$) of less than about 80 nM. In some embodiments, the antibody molecule binds to C5aR1 with a dissociation constant ($K_D$) of less than about 75 nM. In some embodiments, the antibody molecule binds to C5aR1 with a dissociation constant ($K_D$) of less than about 70 nM. In some embodiments, the antibody molecule binds to C5aR1 with a dissociation constant ($K_D$) of less than about 65 nM. In some embodiments, the antibody molecule binds to C5aR1 with a dissociation constant ($K_D$) of less than about 60 nM. In some embodiments, the antibody molecule binds to C5aR1 with a dissociation constant ($K_D$) of less than about 60 nM. In some embodiments, the antibody molecule binds to C5aR1 with a dissociation constant ($K_D$) of less than about 55 nM. In some embodiments, the antibody molecule binds to C5aR1 with a dissociation constant ($K_D$) of less than about 50 nM. In some embodiments, the antibody molecule binds to C5aR1 with a dissociation constant ($K_D$) of less than about 45 nM. In some embodiments, the antibody molecule binds to C5aR1 with a dissociation constant ($K_D$) of less than about 40 nM. In some embodiments, the antibody molecule binds to C5aR1 with a dissociation constant ($K_D$) of less than about 35 nM. In some embodiments, the antibody molecule binds to C5aR1 with a dissociation constant ($K_D$) of less than about 30 nM. In some embodiments, the antibody molecule binds to C5aR1 with a dissociation constant ($K_D$) of less than about 25 nM. In some embodiments, the antibody molecule binds to C5aR1 with a dissociation constant ($K_D$) of less than about 20 nM. In some embodiments, the antibody molecule binds to C5aR1 with a dissociation constant ($K_D$) of less than about 15 nM. In some embodiments, the antibody molecule binds to C5aR1 with a dissociation constant ($K_D$) of less than about 10 nM. In some embodiments, the antibody molecule binds to C5aR1 with a dissociation constant ($K_D$) of less than about 8 nM. In some embodiments, the antibody molecule binds to C5aR1 with a dissociation constant ($K_D$) of less than about 5 nM. In some embodiments, the antibody molecule binds to C5aR1 with a dissociation constant ($K_D$) of less than about 3 nM. In some embodiments, the antibody molecule binds to C5aR1 with a dissociation constant ($K_D$) of less than about 1 nM. In some embodiments, the antibody molecule binds to C5aR1 with a dissociation constant ($K_D$) of less than about 0.5 nM. In some embodiments, the antibody molecule binds to C5aR1 with a dissociation constant ($K_D$) of less than about 0.1 nM. In some embodiments, the antibody molecule binds to C5aR1 with a dissociation constant ($K_D$) of less than about 100 pM. In some embodiments, the antibody molecule binds to C5aR1 with a dissociation constant ($K_D$) of less than about 80 pM. In some embodiments, the antibody molecule binds to C5aR1 with a dissociation constant ($K_D$) of less than about 50 pM. In some embodiments, the antibody molecule binds to C5aR1 with a dissociation constant ($K_D$) of less than about 25 pM. In some embodiments, the antibody molecule binds to C5aR1 with a dissociation constant ($K_D$) of less than about 10 pM.

In some embodiments, the antibody molecule binds to C5aR1 with a dissociation constant ($K_D$) of between 1 pM and 500 nM. In some embodiments, the antibody molecule binds to C5aR1 with a dissociation constant ($K_D$) of between 5 pM and 100 nM. In some embodiments, the antibody molecule binds to C5aR1 with a dissociation constant ($K_D$) of between 10 pM and 50 nM. In some embodiments, the antibody molecule binds to C5aR1 with a dissociation constant ($K_D$) of between 500 pM and 10 nM. In some embodiments, the antibody molecule binds to C5aR1 with a dissociation constant ($K_D$) of between 1 nM and 10 nM. In some embodiments, the antibody molecule binds to C5aR1 with a dissociation constant ($K_D$) of between 1 nM and 50 nM. In some embodiments, the antibody molecule binds to C5aR1 with a dissociation constant ($K_D$) of between 10 nM and 50 nM.

In some embodiments, the antibody molecule reduces C5a-induced chemotaxis.

In some embodiments, the antibody molecule is capable of binding to neutrophils.

In some embodiments, the antibody molecule does not, or does not substantially bind to C5aR2, or other GPCRs.

In one aspect, described herein is an antibody molecule capable of binding to complement component 5a receptor 1 (C5aR1), wherein the antibody molecule comprises: a first immunoglobulin variable region that binds to a first epitope, and a second immunoglobulin variable region that binds to a second epitope, wherein the first epitope is on Site II of C5aR1, comprising amino acid residues of SEQ ID NO: 1450; and wherein the second epitope is on Site I of C5aR1 comprising an amino acid residues of SEQ ID NO: 1449 or SEQ ID NO: 1452.

In some embodiments, the multispecific antibody molecule comprises the first immunoglobulin variable region that binds to amino acid residues R175-G189 in SEQ ID NO: 1450.

In some embodiments, the multispecific antibody molecule comprises the second immunoglobulin variable region that binds to amino acid residues T8-D18 in SEQ ID NO: 1449 or SEQ ID NO: 1452.

In some embodiments, the multispecific antibody molecule comprises the first immunoglobulin variable region that competes with a C5aR1 antibody molecule comprising: a HCDR1 comprising an amino acid sequence of SEQ ID NO: 612, a HCDR2 comprising an amino acid sequence of SEQ ID NO: 732, and a HCDR3 comprising an amino acid sequence of SEQ ID NO: 852, a LCDR1 comprising an amino acid sequence of SEQ ID NO: 672, a LCDR2 comprising an amino acid sequence of SEQ ID NO: 792, and a LCDR3 comprising an amino acid sequence of SEQ ID NO: 912; and wherein the second immunoglobulin variable region competes with a C5aR1 antibody molecule comprising: a HCDR1 comprising an amino acid sequence of SEQ ID NO: 656, a HCDR2 comprising an amino acid sequence of SEQ ID NO: 776, and a HCDR3 comprising an amino acid sequence of SEQ ID NO: 896, a LCDR1 comprising an amino acid sequence of SEQ ID NO: 715, a LCDR2 comprising an amino acid sequence of SEQ ID NO: 835 and a LCDR3 comprising an amino acid sequence of SEQ ID NO: 955.

In one aspect, the present invention provides, among other things a multispecific antibody molecule capable of binding to complement component 5a receptor 1 (C5aR1), wherein the antibody molecule comprises: a first immunoglobulin variable region that binds to a first epitope, and a second immunoglobulin variable region that binds to a second epitope, wherein the first epitope is on Site II of C5aR1; wherein the first immunoglobulin variable region comprises: a HCDR1 comprising an amino acid sequence of SEQ ID NO: 612, a HCDR2 comprising an amino acid sequence of SEQ ID NO: 732, and a HCDR3 comprising an amino acid sequence of SEQ ID NO: 852, a LCDR1 comprising an amino acid sequence of SEQ ID NO: 672, a LCDR2 comprising an amino acid sequence of SEQ ID NO: 792, and a LCDR3 comprising an amino acid sequence of SEQ ID NO: 912; wherein the second epitope is on Site I of C5aR; and wherein the second immunoglobulin variable region comprises: HCDR1 comprising an amino acid sequence of SEQ ID NO: 656, a HCDR2 comprising an amino acid sequence of SEQ ID NO: 776, and a HCDR3 comprising an amino acid sequence of SEQ ID NO: 896, a LCDR1 comprising an amino acid sequence of SEQ ID NO: 715, a LCDR2 comprising an amino acid sequence of SEQ ID NO: 835 and a LCDR3 comprising an amino acid sequence of SEQ ID NO: 955.

A multispecific antibody molecule capable of binding to complement component 5a receptor 1 (C5aR1), wherein the antibody molecule comprises: a first immunoglobulin variable region that binds to a first epitope, and a second immunoglobulin variable region that binds to a second epitope, wherein the first epitope is on Site II of C5aR1; wherein the first immunoglobulin variable region comprises: a HCDR1 comprising an amino acid sequence of SEQ ID NO: 1462, a HCDR2 comprising an amino acid sequence of SEQ ID NO: 1463, and a HCDR3 comprising an amino acid sequence of SEQ ID NO: 1464, a LCDR1 comprising an amino acid sequence of SEQ ID NO: 1465, a LCDR2 comprising an amino acid sequence of SEQ ID NO: 1466, and a LCDR3 comprising an amino acid sequence of SEQ ID NO: 1467; wherein the second epitope is on Site I of C5aR; and wherein the second immunoglobulin variable region comprises: HCDR1 comprising an amino acid sequence of SEQ ID NO: 1456, a HCDR2 comprising an amino acid sequence of SEQ ID NO: 1457, and a HCDR3 comprising an amino acid sequence of SEQ ID NO: 1458, a LCDR1 comprising an amino acid sequence of SEQ ID NO: 1459, a LCDR2 comprising an amino acid sequence of SEQ ID NO: 1460, and a LCDR3 comprising an amino acid sequence of SEQ ID NO: 1461.

In some embodiments, the multispecific antibody molecule is a bispecific or a biparatopic antibody.

In some embodiments, the multispecific antibody is a bispecific or biparatopic antibody molecule comprises a half antibody, or fragment thereof, having binding specificity for the first epitope and a half antibody, or fragment thereof, having binding specificity for the second epitope.

In some embodiments, the multispecific antibody is a bispecific or biparatopic antibody molecule comprises a scFv, or fragment thereof, having binding specificity for the first epitope.

In some embodiments, the multispecific antibody is a bispecific or biparatopic antibody molecule comprises a scFv, or fragment thereof, having binding specificity for the second epitope.

In some embodiments, the multispecific antibody molecule reduces C5a-induced chemotaxis.

In some embodiments, the multispecific antibody molecule is capable of binding to neutrophils.

In some embodiments, the multispecific antibody molecule of does not, or does not substantially bind to C5aR2, or other GPCRs.

In one aspect, described herein is a pharmaceutical composition comprising the antibody molecule disclosed herein and optionally further comprising a pharmaceutically acceptable carrier or excipient.

In one aspect, described herein is a combination comprising an antibody molecule of the present invention and a second therapeutic agent.

In some embodiments, a combination comprises an antibody molecule capable of binding to Site I on C5aR1 and an antibody molecule capable of binding to Site II on C5aR1.

In some embodiments, a combination comprises an antibody Ab 329 and an antibody Ab583.

In some embodiments, the second therapeutic agent comprises a small molecule (e.g., avacopan).

In some embodiments, the combination comprises a second antibody molecule.

In some embodiments, the combination comprises the second antibody molecule is an antibody molecule described herein.

In some embodiments, the second antibody molecule is selected from antibodies 3C5, 7F3, or 7h3.

In one aspect, described herein is a nucleic acid molecule comprising a nucleotide sequence encoding the antibody molecule described herein.

In one aspect, described herein is a vector comprising the nucleic acid antibody molecules described herein.

In one aspect, described herein is a host cell comprising the nucleic acid molecule described herein.

In one aspect, described herein is a method of producing an anti-C5aR1 antibody molecule, the method comprising culturing the host cell under conditions that allow production of an antibody molecule, thereby producing the antibody molecule.

In one embodiment, the method further comprises isolating the antibody molecule.

In one aspect, the method of treating a disease or disorder, the method comprising administering to a subject in need thereof an effective amount of the antibody molecule described herein, the pharmaceutical composition described herein, or the combination described herein, thereby treating the disorder.

In some embodiments, the disorder is a C5aR1-associated (e.g., associated with C5aR1-activation) disorder.

In some embodiments, the disorder is an autoimmune disorder.

In some embodiments, the disorder is rheumatoid arthritis.

In some embodiments, the disorder is a kidney disorder.

In some embodiments, the disorder is ANCA-vasculitis or lupus.

In some embodiments, the disorder is a cancer.

In some embodiments, the method further comprises administering to the subject a second therapeutic agent.

In one aspect, described herein, is a method of modulating (e.g., decreasing) a C5aR1 activity, the method comprising contacting a cell or a subject in need thereof an effective amount of the antibody molecule described herein, the pharmaceutical composition described herein, or the combination of described, thereby modulating (e.g., decreasing) the C5aR1 activity.

In some embodiments, the C5aR1 activity is modulated in vitro, ex vivo, or in vivo.

In one aspect, described herein is an antibody molecule capable of binding to complement component 5a receptor 1 (C5aR1), wherein the antibody molecule binds to an epitope on Site I of C5aR1, wherein the epitope on Site I comprises amino acid residues of SEQ ID NO: 1449 or SEQ ID NO: 1452, and wherein the antibody molecule reduces C5a-induced chemotaxis.

In one aspect, described herein is an antibody molecule capable of binding to complement component 5a receptor 1 (C5aR1), wherein the antibody molecule binds to an epitope on Site I of C5aR1, wherein the epitope on Site I comprises amino acid residues of SEQ ID NO: 1449 or SEQ ID NO: 1452, and wherein the antibody molecule reduces C5a-induced calcium release.

In one aspect, described herein is an antibody molecule capable of binding to complement component 5a receptor 1 (C5aR1), wherein the antibody molecule binds to an epitope on Site I of C5aR1, wherein the epitope on Site I comprises amino acid residues of SEQ ID NO: 1449 or SEQ ID NO: 1452, and wherein the antibody molecule reduces C5a-induced CD11b expression.

In one aspect, described herein is an antibody molecule capable of binding to complement component 5a receptor 1 (C5aR1), wherein the antibody molecule binds to an epitope on Site I of C5aR1, wherein the epitope on Site I comprises amino acid residues of SEQ ID NO: 1449 or SEQ ID NO: 1452, and wherein the antibody molecule binds C5aR1 on human neutrophils.

In one aspect, described herein is an antibody molecule capable of binding to complement component 5a receptor 1 (C5aR1), wherein the antibody molecule binds to an epitope on Site I of C5aR1, wherein the epitope on Site I comprises amino acid residues of SEQ ID NO: 1449 or SEQ ID NO: 1452, and wherein the antibody molecule does not substantially bind C5aR2 or other GPCRs.

In one aspect, described herein is an antibody molecule capable of binding to complement component 5a receptor 1 (C5aR1), wherein the antibody molecule binds to an epitope on Site II of C5aR1, wherein the epitope on Site II comprises amino acid residues of SEQ ID NO: 1450, and wherein the antibody molecule reduces C5a-induced chemotaxis.

In one aspect, described herein is an antibody molecule capable of binding to complement component 5a receptor 1 (C5aR1), wherein the antibody molecule binds to an epitope on Site II of C5aR1, wherein the epitope on Site II comprises amino acid residues of SEQ ID NO: 1450, and wherein the antibody molecule reduces C5a-induced calcium release.

In one aspect, described herein is an antibody molecule capable of binding to complement component 5a receptor 1 (C5aR1), wherein the antibody molecule binds to an epitope on Site II of C5aR1, wherein the epitope on Site II comprises amino acid residues of SEQ ID NO: 1450, and wherein the antibody molecule reduces C5a-induced CD11b expression.

In one aspect, described herein is an antibody molecule capable of binding to complement component 5a receptor 1 (C5aR1), wherein the antibody molecule binds to an epitope on Site II of C5aR1, wherein the epitope on Site II comprises amino acid residues of SEQ ID NO: 1450, and wherein the antibody molecule binds C5aR1 on human neutrophils.

In one aspect, described herein is an antibody molecule capable of binding to complement component 5a receptor 1 (C5aR1), wherein the antibody molecule binds to an epitope on Site II of C5aR1, wherein the epitope on Site II comprises amino acid residues of SEQ ID NO: 1450, and wherein the antibody molecule does not substantially bind C5aR2 or other GPCRs.

In one aspect, described herein is an antibody molecule capable of binding to complement component 5a receptor 1 (C5aR1), wherein the antibody molecule binds to an epitope on Site I and Site II of C5aR1, wherein the epitope on Site I and Site II comprises amino acid residues of SEQ ID NO: 1449, 1452 and 1450, and wherein the antibody molecule reduces C5a-induced chemotaxis.

In one aspect, described herein is an antibody molecule capable of binding to complement component 5a receptor 1 (C5aR1), wherein the antibody molecule binds to an epitope on Site I and Site II of C5aR1, wherein the epitope on Site I and Site II comprises amino acid residues of SEQ ID NO: 1449, 1452 and SEQ ID NO: 1450, and wherein the antibody molecule reduces C5a-induced calcium release.

In one aspect, described herein is an antibody molecule capable of binding to complement component 5a receptor 1 (C5aR1), wherein the antibody molecule binds to an epitope on Site I and Site II of C5aR1, wherein the epitope on Site I and Site II comprises amino acid residues of SEQ ID NO:

1449, 1452 and 1450, and wherein the antibody molecule reduces C5a-induced CD11b expression.

In one aspect, described herein is an antibody molecule capable of binding to complement component 5a receptor 1 (C5aR1), wherein the antibody molecule binds to an epitope on Site I and Site II of C5aR1, wherein the epitope on Site I or Site II comprises amino acid residues of SEQ ID NO: 1449, 1452 or 1450, and wherein the antibody molecule binds C5aR1 on human neutrophils.

In one aspect, described herein is an antibody molecule capable of binding to complement component 5a receptor 1 (C5aR1), wherein the antibody molecule binds to an epitope on Site I and Site II of C5aR1, wherein the epitope on Site I and Site II comprises amino acid residues of SEQ ID NO: 1449, 1452 and 1450, and wherein the antibody molecule does not substantially bind C5aR2 or other GPCRs.

BRIEF DESCRIPTION OF THE DRAWINGS

FIG. 4A is a superposed model of the mAb 329 interacting with ECL2 of C5aR1.

FIG. 4B, shows the residues of the LCDR1 & 3 interacting with the ECL2 of C5aR1.

FIG. 5A is a diagram showing the results of alanine scanning mutations of site I interaction with mab 583. The N-terminal amino acid sequence of C5aR1 is listed across the top of the figure. Glycosylation sites are indicated by rectangle boxes. The only natural glycosylation site is at position N5. The other sites were introduced by mutagenesis. Mutations that abolished clone 583 binding are circled. The sulfated tyrosines at positions 11 and 14 are marked with a star sign. FIG. 5B is a diagram showing results of alanine scanning mutations of site I interaction with mab 66. Mutations that abolished clone 66 binding are circled. The sulfated tyrosines at positions 11 and 14 are marked with a star sign.

FIGS. 8A-8F are a series of graphs showing cell chemotaxis induced by various concentrations of exemplary anti-C5aR1 antibodies 11v2 (FIG. 8A), 66 (FIG. 8B), 322 (FIG. 8C), 329 (FIG. 8D), 336v2-1 (FIG. 8E), and 583 (FIG. 8F).

FIGS. 9A-9D are a series of graphs showing neutrophil chemotaxis induced by various concentrations of exemplary anti-C5aR1 antibodies 11v2 (FIG. 9A), 66 (FIG. 9B), 329 (FIG. 9C), and 583 (FIG. 9D).

FIGS. 12A-12C are a series of graphs showing C5aR1 inhibition of the C5a induced calcium efflux by C5aR1 antibodies in human neutrophil cells—Clone 11v2 (FIG. 12A), Clone 329 (FIG. 12B), and Clone 583 (FIG. 12C).

FIGS. 17A-17C are a series of graphs showing inhibition of calcium flux in C5aR1-U937 cells by antibody 66 (FIG. 17A), antibody 329 (FIG. 17B), or a combination of antibody 66 and antibody 329 (FIG. 17C).

FIGS. 18A-18C is a series of graphs showing inhibition of chemotaxis by antibody 583 (FIG. 18A), antibody 329 (FIG. 18B), or a combination of antibody 583 and antibody 329 (FIG. 18C).

FIGS. 19A-19E is a series of graphs showing of C5aR1 mediated inhibition of Gα signaling as a biparatopic antibody—Clone 329 IgG4, with 583 scFv linked to light chain (FIG. 19A), Clone 336 IgG4, with 583 scFv linked to light chain (FIG. 19B), Clone 11 IgG4, with 583 scFv linked to heavy chain (FIG. 19C), Clone 329 IgG4, with 583 scFv linked to heavy chain (FIG. 19D), Clone 336 IgG4, with 583 scFv linked to heavy chain (FIG. 19E), FIGS. 20A-20G is a series of graphs showing of C5aR1 mediated inhibition of C5aR1 mediated Gα signaling as a biparatopic antibody, targeting both Site I and Site II, in the presence of C5-alpha—Clone 329 IgG4 with Clone 583 scFv linked to heavy chain (FIG. 20A), Clone 329 IgG4 with Clone 583 scFv, linked to light chain (FIG. 20B), Clone 336 IgG4 with Clone 583 scFv linked to heavy chain (FIG. 20C), Clone 11 IgG4 with Clone 583 scFv linked to heavy chain (FIG. 20D) and two IgG4 antibodies—Clone 329 and Clone 583 (FIG. 20E), only IgG-clone 329 (FIG. 20F) and only Clone 583 (FIG. 20G).

FIG. 21A shows treatment with Avacopan 5 hrs before injection of Clone 329 or Clone 583 or biparatopic antibody, blood draw at 10 min before injection of antibody, 1 min post injection, 5 min post injection and 2 hours post injection. FIG. 21B shows treatment with Avacopan 5 hrs before injection of Clone 329 or Clone 583 or biparatopic antibody, blood draw at 5 min before injection of antibody, 1 min post injection, 5 min post injection and 2 hours post injection. FIG. 21C shows treatment with Avacopan 1 hr before injection of Clone 329 or Clone 583 or biparatopic antibody, blood draw at 5 min before injection of antibody, 1 min post injection, 5 min post injection and 2 hours post injection.

DETAILED DESCRIPTION

Figure 1:
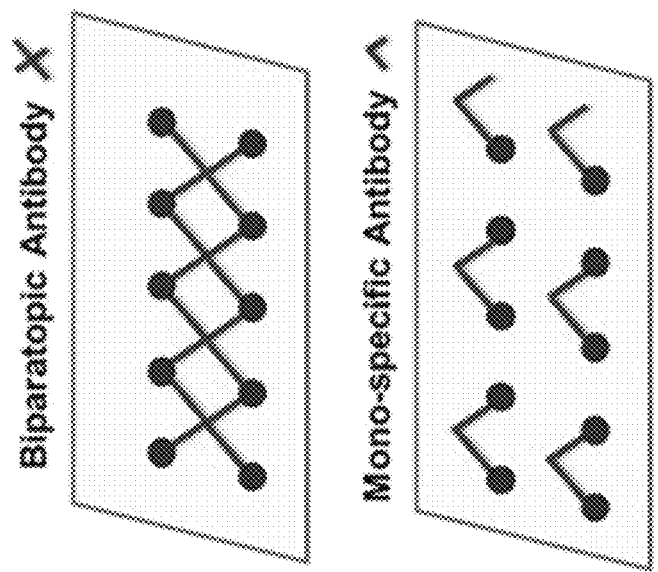
FIG. 1 is a diagram showing that the combination of Site I and Site II antibodies or biparatopic antibodies that bind to Site I and Site II on C5aR1 can result in formation of large clusters, which are not formed by comparable monospecific antibodies.
Figure 2A:
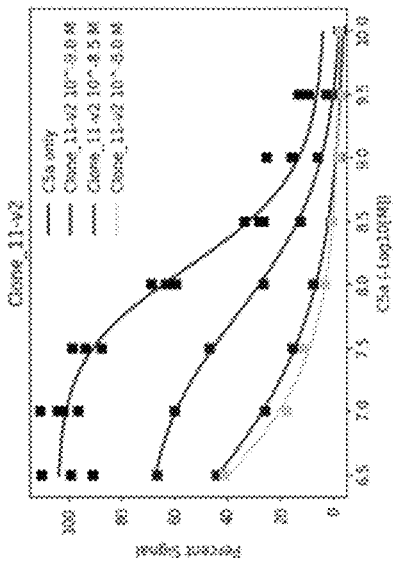
FIGS. 2A-2D are a series of graphs showing the functionality of exemplary anti-C5aR1 antibodies quantified in the GeneBLAzer assay (clone 66 (FIG. 2A), clone 11-v2 (FIG. 2B), clone 583 (FIG. 2C), and clone 329 (FIG. 2D)). C5a concentration was plotted on the x-axis and the percent activation of C5aR1 was plotted on the y-axis. The C5a dose response in the absence of antagonist was plotted in black and the dose response in the presence of varying concentrations of antibody was plotted in shades of gray.
Figure 2B:
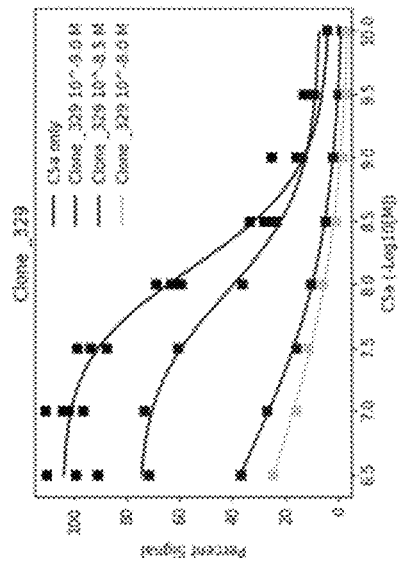
Figure 2C:
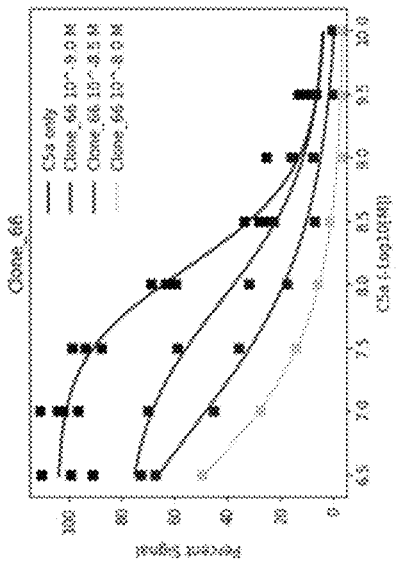
Figure 2D:
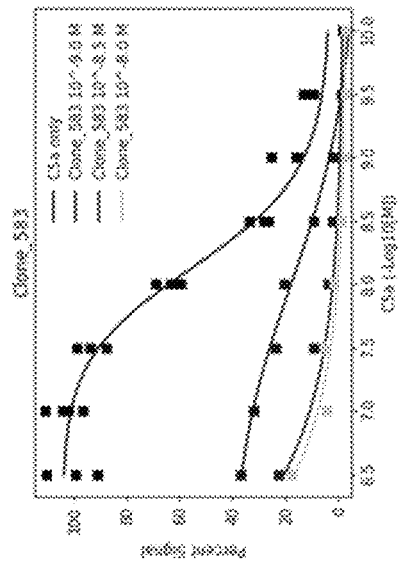

The present invention provides, among other things, anti-C5aR1 antibodies that can effectively inhibit C5a-C5aR inhibition and block C5a signaling in the presence of high C5a concentrations. Additionally, the present invention provides methods and compositions for inhibiting C5aR1 and/or C5a signaling by targeting both Site I and Site II of C5aR1. Simultaneous targeting of Site I and Site II significantly enhances inhibitory activity.

The disclosure herein is base, at least in part, on the identification of antagonistic antibody molecules that inhibit the binding and/or signaling of soluble C5a to C5aR1. Without wishing to be bound by theory, it is believed that in some embodiments, the antibody molecules described herein have one or more of the following characteristics: targeting an epitope on C5aR1 that sterically blocks C5a binding and allosterically prevents C5aR1 from adopting the signaling conformation; strong binding affinity/avidity and a slow off-rate to prevent competition and displacement by C5a; no substantial cross reactivity with the structurally homologous C5aR2 or other GPCRs; lack of Fc effector function to prevent C5aR1-expressing cells from cytotoxic effects; or favorable biophysical, pharmacokinetic, and/or biodistribution properties to allow for prolonged therapeutic effect compared to small molecule antagonists.

C5a/C5aR1 Interaction

The binding of C5a to C5aR1 is a terminal event in the complement pathway that can have a pleiotropic effect, with one major consequence being the migration, trafficking, and/or activation of leukocytes, including, but not limited to, neutrophils. By targeting a terminal step of C5aR1 signaling, the rest of the complement system can remain fully functional. C5aR1 blockade by a small molecule allosteric antagonist, CCX168 (avacopan), has been clinically validated and in a Phase III clinical trial for patients with ANCA vasculitis. The antibody molecules described herein can, at least in part, reduce aberrant inflammation and/or tissue damage by inhibiting (e.g., blocking) C5aR1 signaling and subsequent chemotaxis and activation of leukocytes to the site of inflammation. An antibody therapeutic targeting C5aR1 provides an approach for specific blockade of C5a/C5aR1 signaling (e.g., blocking C5a signaling in the presence of high C5a concentrations). Additionally, the biophysical properties, biodistribution, and/or PK properties of an antibody molecule are often superior to small molecule drugs—for example, prolonged serum half-life and reduced administration frequency, high specificity and/or affinity, and/or a favorable developability profile. Furthermore, many small molecules targeting GPCRs often have promiscuity across multiple GPCRs due to the conserved canonical structure and the small number of contact residues. Antibodies can provide improved specificity by engaging with multiple contacts across a conformational landscape.

Due to the biparatopic nature of C5a, which binds independently to two distinct regions of C5aR1, antagonistic mimicry by engagement of C5aR1 with a biparatopic antibody targeting binding Site I and Site II can provide a potent strategy for inhibiting C5a signaling. For example, engagement of Site I and Site II can provide the most potent antagonism by orthosterically blocking both C5a binding sites and possible increase the avidity and/or cross-link receptors. Without wishing to be bound by theory, it is believed that in some embodiments, intramolecular or intermolecular engagement of Site I and Site II by a single biparatopic antibody can mask multiple (e.g., all) C5a binding sites, while also increasing the off-rate and residence time of the antibody molecule. The life span of a neutrophil is estimated to be less than 24 hours; therefore, it is believed that in some embodiments, an antibody molecule with a long residence time can occupy C5aR1 for the lifespan of the cell. Without wishing to be bound by theory, it is believed that in some embodiments, the antibody molecules described herein can have improved properties (e.g., improved target engagement, pharmacokinetics (PK), and efficiency) due to improved residence time compared to small molecule antagonists for improved pharmacodynamics (PD).

Disclosed herein are antibody molecules that bind to C5aR1, e.g., human C5aR1 with high affinity and specificity. Advantageously, several of the antibody molecules describe herein have improved ability to reduce (e.g., inhibit, block, or neutralize) one or more biological activities of C5aR1. Nucleic acid molecules encoding the antibody molecules, expression vectors, host cells, compositions (e.g., pharmaceutical compositions), kits, and methods for making the antibody molecules, are also provided. The antibody molecules and pharmaceutical compositions disclosed herein can be used (alone or in combination with other agents or therapeutic modalities) to treat, prevent and/or diagnose disorders and conditions, e.g., disorders and conditions associated with C5aR1, e.g., ANCA-vasculitis.

Definitions

As used herein, the articles "a" and "an" refer to one or to more than one (e.g., to at least one) of the grammatical object of the article.

The term "or" is used herein to mean, and is used interchangeably with, the term "and/or", unless context clearly indicates otherwise.

"About" and "approximately" shall generally mean an acceptable degree of error for the quantity measured given the nature or precision of the measurements. Exemplary degrees of error are within 20 percent (%), typically, within 10%, and more typically, within 5% of a given value or range of values.

The compositions and methods disclosed herein encompass polypeptides and nucleic acids having the sequences specified, or sequences substantially identical or similar thereto, e.g., sequences at least 85%, 90%, 95% identical or higher to the sequence specified.

In the context of an amino acid sequence, the term "substantially identical" is used herein to refer to a first amino acid that contains a sufficient or minimum number of amino acid residues that are i) identical to, or ii) conservative substitutions of aligned amino acid residues in a second amino acid sequence such that the first and second amino acid sequences can have a common structural domain and/or common functional activity. For example, amino acid sequences that contain a common structural domain having at least about 85%, 90%, 91%, 92%, 93%, 94%, 95%, 96%, 97%, 98% or 99% identity to a reference sequence, e.g., a sequence provided herein.

In the context of nucleotide sequence, the term "substantially identical" is used herein to refer to a first nucleic acid sequence that contains a sufficient or minimum number of nucleotides that are identical to aligned nucleotides in a second nucleic acid sequence such that the first and second nucleotide sequences encode a polypeptide having common functional activity, or encode a common structural polypeptide domain or a common functional polypeptide activity. For example, nucleotide sequences having at least about 85%, 90%, 91%, 92%, 93%, 94%, 95%, 96%, 97%, 98% or 99% identity to a reference sequence, e.g., a sequence provided herein.

The term "functional variant" refers polypeptides that have a substantially identical amino acid sequence to the naturally occurring sequence, or are encoded by a substantially identical nucleotide sequence, and are capable of having one or more activities of the naturally-occurring sequence.

Calculations of homology or sequence identity between sequences (the terms are used interchangeably herein) are performed as follows.

To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a typical embodiment, the length of a reference sequence aligned for comparison purposes is at least 30%, e.g., at least 40%, 50%, 60%, e.g., at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position.

The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In an embodiment, the percent identity between two amino acid sequences is determined using the Needleman and Wunsch ((1970) *J. Mol. Biol.* 48:444-453) algorithm which has been incorporated into the GAP program in the GCG software package (available at www.gcg.com), using either a Blossum 62 matrix or a PAM250 matrix, and a gap weight of 16, 14, 12, 10, 8, 6, or 4 and a length weight of 1, 2, 3, 4, 5, or 6. In certain embodiments, the percent identity between two nucleotide sequences is determined using the GAP program in the GCG software package (available at www.gcg.com), using a NWSgapdna.CMP matrix and a gap weight of 40, 50, 60, 70, or 80 and a length weight of 1, 2, 3, 4, 5, or 6. One suitable set of parameters (and the one that should be used unless otherwise specified) are a Blossum 62 scoring matrix with a gap penalty of 12, a gap extend penalty of 4, and a frameshift gap penalty of 5.

The percent identity between two amino acid or nucleotide sequences can be determined using the algorithm of E. Meyers and W. Miller ((1989) CABIOS, 4:11-17) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul, et al. (1990) *J. Mol. Biol.* 215: 403-10. BLAST nucleotide searches can be performed with the NBLAST program, score=100, wordlength=12 to obtain nucleotide sequences homologous to a nucleic acid as described herein. BLAST protein searches can be performed with the XBLAST program, score=50, wordlength=3 to obtain amino acid sequences homologous to protein molecules described herein. To obtain gapped alignments for comparison purposes, Gapped BLAST can be utilized as described in Altschul et al., (1997) *Nucleic Acids Res.* 25:3389-3402. When utilizing BLAST and gapped BLAST programs, the default parameters of the respective programs (e.g., XBLAST and NBLAST) can be used. See www.ncbi.nlm.nih.gov.

As used herein, the term "hybridizes under low stringency, medium stringency, high stringency, or very high stringency conditions" describes conditions for hybridization and washing. Guidance for performing hybridization reactions can be found in *Current Protocols in Molecular Biology*, John Wiley & Sons, N.Y. (1989), 6.3.1-6.3.6, which is incorporated by reference. Aqueous and nonaqueous methods are described in that reference and either can be used. Specific hybridization conditions referred to herein are as follows: 1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); 2) medium stringency hybridization conditions in 6×SSC at about 45° C., followed by one or more washes in 0.2×SSC, 0.1% SDS at 60° C.; 3) high stringency hybridization conditions in 6×SSC at about 45° C., followed by one or more washes in 0.2×SSC, 0.1% SDS at 65° C.; and preferably 4) very high stringency hybridization conditions are 0.5M sodium phosphate, 7% SDS at 65° C., followed by one or more washes at 0.2×SSC, 1% SDS at 65° C. Very high stringency conditions 4) are suitable conditions and the ones that should be used unless otherwise specified.

It is understood that the molecules described herein may have additional conservative or non-essential amino acid substitutions, which do not have a substantial effect on their functions.

The term "amino acid" is intended to embrace all molecules, whether natural or synthetic, which include both an amino functionality and an acid functionality and capable of being included in a polymer of naturally-occurring amino acids. Exemplary amino acids include naturally-occurring amino acids; analogs, derivatives and congeners thereof; amino acid analogs having variant side chains; and all stereoisomers of any of any of the foregoing. As used herein the term "amino acid" includes both the D- or L-optical isomers and peptidomimetics.

A "conservative amino acid substitution" is one in which the amino acid residue is replaced with an amino acid residue having a similar side chain Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

The terms "polypeptide," "peptide" and "protein" (if single chain) are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. The polypeptide can be isolated from natural sources, can be a produced by recombinant techniques from a eukaryotic or prokaryotic host, or can be a product of synthetic procedures.

The terms "nucleic acid," "nucleic acid sequence," "nucleotide sequence," or "polynucleotide sequence," and "polynucleotide" are used interchangeably. They refer to a polymeric form of nucleotides of any length, either deoxyribonucleotides or ribonucleotides, or analogs thereof. The polynucleotide may be either single-stranded or double-stranded, and if single-stranded may be the coding strand or non-coding (antisense) strand. A polynucleotide may comprise modified nucleotides, such as methylated nucleotides and nucleotide analogs. The sequence of nucleotides may be interrupted by non-nucleotide components. A polynucleotide may be further modified after polymerization, such as by conjugation with a labeling component. The nucleic acid may be a recombinant polynucleotide, or a polynucleotide of genomic, cDNA, semisynthetic, or synthetic origin which either does not occur in nature or is linked to another polynucleotide in a non-natural arrangement.

The term "isolated," as used herein, refers to material that is removed from its original or native environment (e.g., the natural environment if it is naturally occurring). For example, a naturally-occurring polynucleotide or polypeptide present in a living animal is not isolated, but the same polynucleotide or polypeptide, separated by human intervention from some or all of the co-existing materials in the natural system, is isolated. Such polynucleotides could be part of a vector and/or such polynucleotides or polypeptides could be part of a composition, and still be isolated in that such vector or composition is not part of the environment in which it is found in nature.

As used herein, the term "treat," e.g., a disorder (e.g., a disorder described herein), means that a subject (e.g., a human) who has a disorder, e.g., a disorder described herein, and/or experiences a symptom of a disorder, e.g., a disorder described herein, will, in an embodiment, suffer less a severe symptom and/or recover faster when an antibody molecule is administered than if the antibody molecule were never administered. Other assays, e.g., urine tests, blood tests, iothalamate clearance tests, or imaging (e.g., ultrasound, X-rays, or cystoscopy), can also be used to monitor treatment in a patient, or to detect the presence, e.g., decreased presence (or absence), of a symptom of the disorder, after treatment of the disorder in the subject. Treatment can, e.g., partially or completely, alleviate, ameliorate, relieve, inhibit, or reduce the severity of, and/or reduce incidence, and optionally, delay onset of, one or more manifestations of the effects or symptoms, features, and/or causes of a disorder, e.g., a disorder described herein. In an embodiment, treatment is of a subject who does not exhibit certain signs of a disorder, e.g., a disorder described herein, and/or of a subject who exhibits only early signs of a disorder, e.g., a disorder described herein. In an embodiment, treatment is of a subject who exhibits one or more established signs of a disorder, e.g., a disorder described herein. In an embodiment, treatment is of a subject diagnosed as suffering from a disorder, e.g., a disorder described herein.

As used herein, the term "prevent," a disorder, e.g., a disorder described herein, means that a subject (e.g., a human) is less likely to have the disorder, e.g., a disorder described herein, if the subject receives the antibody molecule.

Various aspects of the compositions and methods herein are described in further detail below. Additional definitions are set out throughout the specification.

C5aR1

C5aR1 (complement component 5a receptor 1), also known as complement 5a receptor 1, C5a receptor, cluster of differentiation 88 (CD88), or C5a anaphylatoxin chemotactic receptor 1, is a G protein-coupled receptor encoded by the Complement C5a Receptor 1 (C5AR1) gene. Most GPCR molecules are randomly distributed on the cell surface and most class A GPCRs are monomers. C5aR1 belongs to class A of GPCRs but is likely to be present as oligomers. The oligomeric GPCR molecules may become monomers upon their respective antagonist binding suggesting that the oligomerization is likely due to nonspecific interactions. C5aR1 is the receptor for Complement Component 5a (C5a) and plays a role in a number of biological processes, such as modulation of inflammatory responses, obesity, development, and cancer. C5aR1 is broadly expressed, for example, in granulocytes (e.g., neutrophils, eosinophils, basophils, and mast cells), and immature dendritic cells, as well as in the brain, lung, heart, kidney, liver, ovary, and testis. C5aR1 is also found on the plasma membrane. The number of C5 receptors per cell is significantly high, up to about 200,000 sites per leukocytes.

C5a has a high affinity for C5aR1, with measurements ranging from low nanomolar to low picomolar. Due to low molecular weight, on rate is fast (about 4.8e8 $M^{-1}min^{-1}$). The Kd for C5aR1 on neutrophil is typically in the low nanomolar to high picomolar range (depending on assay format and presence of G-proteins). Engagement for only 1-2 seconds is typically needed for G-protein signaling, which supports the importance of having high residence time of a C5aR1 inhibitor (e.g., an antibody molecule described herein). GPCRs can have multiple conformational states that will vary in their level of activity (e.g., not binary). Without wishing to be bound by theory, it is believed that in some embodiments, the antibody molecules described herein can shift the energetics to favor an inactive state upon engagement.

C5aR1 is a class 1 G-coupled protein receptor (GPCR), which possesses the canonical GPCR structure, including 7 transmembrane helices, 4 extracellular domains, and 4 intracellular domains. C5aR1 comprises two regions exposed to the extracellular milieu that are involved in its interaction with the C5a ligand. One region, referred to herein as "Site I," typically comprises the N-terminal residues (e.g., N-terminal 37 residues) of C5aR1. Site I generally forms a flexible random coil structure. In an embodiment, Site I comprises or consists of the amino acid sequence of MNSFNYTTPDYGHYDDKDTLD-LNTPVDKTSNTLRVPD (SEQ ID NO: 1449). In an embodiment, an antibody molecule that binds to Site I binds to an amino acid sequence comprising or consisting of SEQ ID NO: 1449, or a sequence having at least 85%, 90%, 95%, 96%, 97%, 98%, or 99% identity thereto, or a sequence comprising no more than 1, 2, 3, 4, 5, 6, 7, 8, 9, or 10 amino acid differences therefrom. In an embodiment, Site I comprises or consists of the amino acid sequence of MDSFNYTTPDYGHYDDKDTLDLNTPVDKTSN-TLRVPD (SEQ ID NO: 1452). In an embodiment, an antibody molecule that binds to Site I binds to an amino acid sequence comprising or consisting of SEQ ID NO: 1452, or a sequence having at least 85%, 90%, 95%, 96%, 97%, 98%, or 99% identity thereto, or a sequence comprising no more than 1, 2, 3, 4, 5, 6, 7, 8, 9, or 10 amino acid differences therefrom. An antibody molecule that binds to Site I can typically bind to all residues in Site I or a subset thereof. For example, an antibody molecule that binds to Site I makes contact with one or more residues in Site I. In an embodiment, Site I generally comprises a number of sulfated residues (e.g., sulfated tyrosine resides) and a number of Asp residues. Without wishing to be bound by theory, it is believed that in some embodiments, Site I recruits C5a to the receptor by binding to C5a as a flexible extension from the rest of the C5aR1 protein, thereby enriching the local concentration of C5a around a C5aR1-expressing cell.

C5aR1 comprises three extracellular loops (ECLs), referred to here as extracellular loop 1 (ECL1), extracellular loop 2 (ECL2) and extracellular loop 3 (ECL3). ECL1 comprises residues 94-110 of C5aR1 and is defined by amino acid sequence of SEQ ID NO: 1453. ECL2 comprises residues 175-200 of C5aR1 and is defined by amino acid sequence of SEQ ID NO: 1450. ECL3 comprises residues 266-282 of C5aR1 and is defined by amino acid sequence of SEQ ID NO: 1454. Certain amino acids of C5aR1 have natural variants such as N2D and N279K.

A second region, referred to herein as "Site II," may comprise the three extracellular loops (e.g., ECL1, ECL2, and ECL3) and the transmembrane residues forming vestibule of C5aR1. Site II typically comprises ECL 2 and optionally, the transmembrane residues forming vestibule of C5aR1 comprising amino acid sequences of SEQ ID NO: 1450. An antibody molecule that binds to Site II can typically bind to all residues in Site II or a subset thereof. For example, an antibody molecule that binds to Site II makes contact with one or more residues in Site II. Similarly, an antibody molecule that binds to ECL1, ECL2, and/or ECL3 makes contact with one or more residues in ECL1, ECL2, and/or ECL3. In an embodiment, an antibody molecule that binds to Site II binds to ECL2. In an embodiment, an antibody molecule that binds to Site II binds to ECL1. In an embodiment, an antibody molecule that binds to Site II binds to ECL3. In an embodiment, an antibody molecule that binds to Site II binds to ECL1 and ECL2. In an embodiment, an antibody molecule that binds to Site II binds to ECL2 and ECL3. In an embodiment, an antibody molecule that binds to Site II binds to ECL1 and ECL3. In an embodiment, an antibody molecule that binds to Site II binds to ECL1, ECL2, and ECL3. In an embodiment, an antibody molecule that binds to Site II binds to ECL2, but does not bind, or does not substantially bind, to ECL1 and/or ECL3. In an embodiment, an antibody molecule that binds to Site II binds to ECL1, but does not bind, or does not substantially bind, to ECL2 and/or ECL3. In an embodiment, an antibody molecule that binds to Site II binds to ECL2, but does not bind, or does not substantially bind, to ECL1 and/or ECL3. In an embodiment, an antibody molecule that binds to Site II binds to ECL2 and to one or more residues in ECL1 and/or ECL3. In an embodiment, an antibody molecule that binds to Site II binds to ECL1 and ECL2, but does not bind, or does not substantially bind, to ECL3. In an embodiment, an antibody molecule that binds to Site II binds to ECL1 and ECL3, but does not bind, or does not substantially bind, to ECL2. In an embodiment, an antibody molecule that binds to Site II binds to ECL2 and ECL3, but does not bind, or does not substantially bind, to ECL1. In an embodiment, an antibody molecule that binds to Site II further binds one or more transmembrane residues (e.g., the transmembrane residues forming the vestibule region). In an embodiment, an antibody molecule that binds to Site II does not bind, or does not substantially bind, to one or more transmembrane residues (e.g., the transmembrane residues forming the vestibule region). The ECL2 generally comprises solvent-exposed Phe and Tyr residues. Without wishing to be bound by theory, it is believed that in some embodiments, C5a binding to Site II is important for activation of downstream signaling by C5aR1.

The energy of agonist binding to the extracellular domain transmits an allosteric conformational change to the transmembrane and intracellular domains, allowing for G-protein binding and signaling. C5aR1 has two known agonists: C5a and $C5a^{desArg}$. C5a has a short half-life in serum as the C-terminal arginine is quickly cleaved by carboxypeptidase N to form $C5a^{desArg}$, which binds to C5aR1 with reduced affinity and displays biased signaling. $C5a^{desArg}$, unlike C5a, does not signal the Gα pathway and does not stimulate granulocyte release. However, $C5a^{desArg}$ does stimulate neutrophil chemotaxis, so it is of interest to also block $C5a^{desArg}$ binding to prevent neutrophil migration to the site of inflammation. $C5a^{desArg}$ signaling favors chemotaxis and is not prone to desensitization (e.g., neutrophils continue to migrate until reach high concentrations of C5a, not $C5a^{desArg}$). In an embodiment, an orthosteric antagonist that blocks C5a binding (e.g., an antibody molecule as described herein) also inhibits (e.g., blocks) C5a$^{desArg}$ binding. Inhibition of C5a binding is, in some embodiments, needed at the inflammation site while inhibition of C5a$^{desArg}$ is at periphery and can prevent the migration of neutrophils to the inflammation site. Targeting C5aR1 typically leave the membrane attack complex pathway (C5b) untouched.

C5a/C5aR1 signaling generally involves the following steps: receptor recognition, activation, and signaling. C5a engagement with C5aR1 involves binding to two sites (sometimes referred to herein as Site I and Site II) in a step-wise manner C5a first engages with Site I on the N-terminal domain of C5aR1, an interaction that is largely driven by the sulfated tyrosines and acidic residues on the N-terminus with basic residues on C5a. Additional contacts are made with basic residues on Site II, e.g., located on the second extracellular loop (ECL2) of C5aR1, and acidic residues on C5a. Once fully engaged, the C-terminus of C5a promotes activation, primarily driven by the terminal arginine on the C-terminus of C5a with aspartic acid at position 282 of C5aR1. C5a binding Site II is essential for C5aR1 signaling, while Site I may not be required. Once engaged, activation is initiated by a rearrangement of the contacts made between transmembrane helices 3, 6 and 7, which drives the allosteric conformational change to the intracellular side of C5aR1 required for G-protein binding. Functional validation of the importance of Site I and Site II for C5a engagement and signaling are evident by the existence of orthosteric antagonists that target either Site I or Site II.

An exemplary amino acid sequence of human C5aR1 (SEQ ID NO: 1448) is provided as follows.

```
>Human NP_001727.1 C5a anaphylatoxin chemotactic
receptor 1 [Homo sapiens]
                                       (SEQ ID NO: 1448)
MNSFNYTTPDYGHYDDKDTLDLNTPVDKTSNTLRVPDILALVIFAVVF

LVGVLGNALVVWVTAFEAKRTINAIWFLNLAVADFLSCLALPILFTSI

VQHHHWPFGGAACSILPSLILLNMYASILLLATISADRFLLVFKPIWC

QNFRGAGLAWIACAVAWGLALLLTIPSFLYRVVREEYFPPKVLCGVDY

SHDKRRERAVAIVRLVLGFLWPLLTLTICYTFILLRTWSRRATRSTKT

LKVVVAVVASFFIFWLPYQVTGIMMSFLEPSSPTFLLLNKLDSLCVSF

AYINCCINPIIYVVAGQGFQGRLRKSLPSLLRNVLTEESVVRESKSFT

RSTVDTMAQKTQAV
```

The domains and key regions of the exemplary human C5aR1 sequence of SEQ ID NO: 1448 are depicted in the annotated sequence provided below. The N-terminal peptide (residues 1-37) is shown in bold and italic; the transmembrane helix residues (residues 38-64, 70-93, 111-132, 154-174, 201-226, 243-265 and 283-303) are underlined; ECL1 (residues 94-110), ECL2 (residues 175-200) and ECL3 (residues 266-282) are shown in bold, without italics. Certain amino acids have natural variants (N2D and N279K), shown as lowercase letters below.

```
            10         20         30         40
    MnSFNYTTPD YGHYDDKDTL DLNTPVDKTS NTLRVPDILA 50         60         70         80
    LVIFAVVFLV GVLGNALVVW VTAFEAKRTI NAIWFLNLAV 90        100        110        120
    ADFLSCLALP ILFTSIVQHH HWPFGGAACS ILPSLILLNM 130        140        150        160
    YASILLLATI SADRFLLVFK PIWCQNFRGA GLAWIACAVA 170        180        190        200
    WGLALLLTIP SFLYRVVREE YFPPKVLCGV DYSHDKRRER 210        220        230        240
    AVAIVRLVLG FLWPLLTLTI CYTFILLRTW SRRATRSTKT 250        260        270        280
    LKVVVAVVAS FFIFWLPYQV TGIMMSFLEP SSPTFLLLnK 290        300        310        320
    LDSLCVSFAY INCCINPIIY VVAGQGFQGR LRKSLPSLLR 330        340        350
    NVLTEESVVR ESKSFTRSTV DTMAQKTQAV
```

As used herein, when an anti-C5aR1 antibody molecule binds, or substantially binds, to human C5aR1, it binds, or substantially binds, to one or more isoforms of human C5aR1, e.g., one or more isoforms of human C5aR1 described herein. In an embodiment, the antibody molecule binds or substantially binds to human C5aR1 having the amino acid sequence of SEQ ID NO: 1448.

In an embodiment, the antibody molecule binds to Site I of C5aR1 (e.g., human C5aR1). An exemplary human C5aR1 Site I comprises or consists of the amino acid sequence of:

```
                                       (SEQ ID NO: 1449)
    MNSFNYTTPDYGHYDDKDTLDLNTPVDKTSNTLRVPD.
```

In an embodiment, the antibody molecule binds to the amino acid sequence of SEQ ID NO: 1449, or a sequence having at least 85%, 90%, 95%, 96%, 97%, 98%, or 99% identity thereto, or a sequence comprising no more than 1, 2, 3, 4, 5, 6, 7, 8, 9, or 10 amino acid differences therefrom. In an embodiment, the antibody molecule binds to a region comprising at least 5 (e.g., at least 5, 10, 15, 20, 25, 30, 31, 32, 33, 34, 35, 36, or 37) amino acids (e.g., consecutive amino acids) of SEQ ID NO: 1449. Another exemplary human C5aR1 Site I comprises or consists of the amino acid sequence of:

```
                                       (SEQ ID NO: 1452)
    MDSFNYTTPDYGHYDDKDTLDLNTPVDKTSNTLRVPD.
```

In an embodiment, the antibody molecule binds to the amino acid sequence of SEQ ID NO: 1452, or a sequence having at least 85%, 90%, 95%, 96%, 97%, 98%, or 99% identity thereto, or a sequence comprising no more than 1, 2, 3, 4, 5, 6, 7, 8, 9, or 10 amino acid differences therefrom. In an embodiment, the antibody molecule binds to a region comprising at least 5 (e.g., at least 5, 10, 15, 20, 25, 30, 31, 32, 33, 34, 35, 36, or 37) amino acids (e.g., consecutive amino acids) of SEQ ID NO: 1452.

In an embodiment, the antibody molecule binds to ECL2 of Site II of C5aR1 (e.g., human C5aR1). An exemplary human C5aR1 ECL2 comprises or consists of:

```
                                       (SEQ ID NO: 1450)
    RVVREEYFPPKVLCGVDYSHDKRRER
```

(core epitope region underlined). In an embodiment, the antibody molecule binds to the amino acid sequence of SEQ ID NO: 1450, or a sequence having at least 85%, 90%, 95%, 96%, 97%, 98%, or 99% identity thereto, or a sequence comprising no more than 1, 2, 3, 4, 5, 6, 7, 8, 9, or 10 amino acid differences therefrom. In an embodiment, the antibody molecule binds to a region comprising at least 5 (e.g., at least 5, 10, 15, 20, 25, 26, or 27) amino acids (e.g., consecutive amino acids) of SEQ ID NO: 1450. In an embodiment, the antibody molecule binds to a region comprising at least 5 (e.g., at least 5, 10, 15, 16, 17, 18, or 19) amino acids (e.g., consecutive amino acids) of the underlined portion of SEQ ID NO: 1450.

In an embodiment, the antibody molecule binds to ECL1 of Site II of C5aR1 (e.g., human C5aR1). An exemplary human C5aR1 ECL1 comprises or consists of: TSIVQHHHWPFGGAACS (SEQ ID NO: 1453). In an embodiment, the antibody molecule binds to the amino acid sequence of SEQ ID NO: 1453, or a sequence having at least 85%, 90%, 95%, 96%, 97%, 98%, or 99% identity thereto, or a sequence comprising no more than 1, 2, 3, 4, 5, 6, 7, 8, 9, or 10 amino acid differences therefrom. In an embodiment, the antibody molecule binds to a region comprising at least 5 (e.g., at least 5, 10, 15, 16, or 17) amino acids (e.g., consecutive amino acids) of SEQ ID NO: 1453.

In an embodiment, the antibody molecule binds to ECL3 of Site II of C5aR1 (e.g., human C5aR1). An exemplary human C5aR1 ECL3 comprises: SFLEPSSPTFLLLNKLD (SEQ ID NO: 1454). In an embodiment, the antibody molecule binds to the amino acid sequence of SEQ ID NO: 1454, or a sequence having at least 85%, 90%, 95%, 96%, 97%, 98%, or 99% identity thereto, or a sequence comprising no more than 1, 2, 3, 4, 5, 6, 7, 8, 9, or 10 amino acid differences therefrom. In an embodiment, the antibody molecule binds to a region comprising at least 5 (e.g., at least 5, 10, 15, 16, or 17) amino acids (e.g., consecutive amino acids) of SEQ ID NO: 1454. Another exemplary human C5aR1 ECL3 comprises or consists of: SFLEPSSPT-FLLLKKLD (SEQ ID NO: 1455). In an embodiment, the antibody molecule binds to the amino acid sequence of SEQ ID NO: 1455, or a sequence having at least 85%, 90%, 95%, 96%, 97%, 98%, or 99% identity thereto, or a sequence comprising no more than 1, 2, 3, 4, 5, 6, 7, 8, 9, or 10 amino acid differences therefrom. In an embodiment, the antibody molecule binds to a region comprising at least 5 (e.g., at least 5, 10, 15, 16, or 17) amino acids (e.g., consecutive amino acids) of SEQ ID NO: 1455.

An exemplary amino acid sequence of mouse C5aR1 (SEQ ID NO: 1451) is provided as follows.

```
mouse C5aR1
                                        (SEQ ID NO: 1451)
MDPIDNSSFEINYDHYGTMDPNIPADGIHLPKRQPGDVAALIIYSVVF

LVGVPGNALVVWVTAFEARRAVNAIWFLNLAVADLLSCLALPVLFTTV

LNHNYWYFDATACIVLPSLILLNMYASILLLATISADRFLLVFKPIWC

QKVRGTGLAWMACGVAWVLALLLTIPSFVYREAYKDFYSEHTVCGINY

GGGSFPKEKAVAILRLMVGFVLPLLTLNICYTFLLLRTWSRKATRSTK

TLKVVMAVVICFFIFWLPYQVTGVMIAWLPPSSPTLKRVEKLNSLCVS

LAYINCCVNPIIYVMAGQGFHGRLLRSLPSIIRNALSEDSVGRDSKTF

TPSTTDTSTRKSQAV
```

As used herein, when an anti-C5aR1 antibody molecule binds, or substantially binds, to C5aR1, it binds, or substantially binds, to one or more isoforms of C5aR1, e.g., one or more isoforms of C5aR1 described herein. In an embodiment, the antibody molecule binds or substantially binds to C5aR1 having the amino acid sequence of SEQ ID NO: 1451.

As used herein, when an anti-C5aR1 antibody molecule does not bind, or does not substantially bind, to C5aR1, it does not bind, or does not substantially bind, to one or more isoforms of C5aR1, e.g., one or more isoforms of C5aR1 described herein. In an embodiment, the antibody molecule does not bind, or does not substantially bind, to C5aR1 having the amino acid sequence of SEQ ID NO: 1451.

Epitope

The antibody molecule described herein can bind to an epitope on C5aR1 (e.g., human C5aR1). For example, an epitope bound by an antibody molecule described herein can include one or more epitope contact points.

The antibody molecules described herein can bind to one or more residues on C5aR1. The amino acids bound by the antibody molecules described herein are defined as "epitope" or "epitope contact points."

In some embodiments, the antibody molecules described herein are designed to target sulfated N-terminal peptide or Site I of C5aR1, defined by SEQ ID NO: 1449 or SEQ ID NO: 1452. In some embodiments, the Site I residues targeted by the antibody molecules described herein, are sulfated. In some embodiments one or more of amino acid residues T8 (threonine 8), D10 (aspartate 10), Y11 (tyrosine 11), Y14 (tyrosine 14) and/or D15 (aspartate 15) are critical Site I epitope contact points. In some embodiments all of amino acid residues T8 (threonine 8), D10 (aspartate 10), Y11 (tyrosine 11), Y14 (tyrosine 14) and/or D15 (aspartate 15) are critical Site I epitope contact points. In some embodiments, the sulfation at Y11 and/or Y14 are critical for binding of Site I antibody molecules described herein. In some embodiments, core epitope spans 12 amino acids from T7 to D18 of SEQ ID NO: 1448, for binding of Site I antibody molecules described herein. In some embodiments, core epitope spans amino acids from T8 to D18 of SEQ ID NO: 1448, for binding of Site I antibody molecules described herein.

The initial site of engagement for C5a binding; the *S. aureus* CHIPS protein binds the N-terminal peptide, which makes contact with both sulfated tyrosines, potently blocks C5aR1 signaling by C5a; and mutation of the tyrosines at positions 11 and 14 to phenylalanine significantly reduces the functionality of C5aR1 signaling by C5a; and sulfate groups can provide strong binding energy to produce a high affinity antibody.

In some embodiments, the antibody molecules described herein are designed to target Site II, defined by amino acids of SEQ ID NO: 1450. In some embodiments amino acid encompassing R175 to G189 of SEQ ID NO: 1448 are core epitopes for binding of Site II antibody molecules described herein. In some embodiments, amino acid encompassing E180-P183 of SEQ ID NO: 1448 are core epitopes for binding of Site II antibody molecules described herein. In some embodiments, amino acid encompassing E180-P184 of SEQ ID NO: 1448 are core epitopes for binding of Site II antibody molecules described herein. In some embodiments, amino acid encompassing E178-P183 of SEQ ID NO: 1448 are core epitopes for binding of Site II antibody molecules described herein. In some embodiments, one or more of the residues R35, H101, V176, V177, R178, E179, E180, Y181, F182, P183 P184, K185, L187, D191, 5193, H194, E266, P267, 5268, F272, L273 and/or K276 of SEQ ID NO: 1448 are important for binding of Site II antibodies described herein. In some embodiments one or more of the residues E180, Y181, F182, and/or P183 of SEQ ID NO:

1448 are critical epitopes for binding of Site II antibodies described herein. In one embodiment, the amino acid residue W102 of SEQ ID NO: 1448 is critical for binding of Site II antibodies described herein. Without wishing to be bound by theory, it is believed that in some embodiments, the antibody molecules described herein are designed to target Site II of C5aR1, at least in part, because it is an orthosteric inhibitor to prevent docking of the C5a C-terminus into the binding pocket, which is responsible for C5aR1 signaling.

In an embodiment, the antibody molecules described herein are designed to target both Site I and Site II of C5aR1. In an embodiment, the antibody molecules described herein are designed to target both sulfated N-terminal peptide within Site I of C5aR1 and the ECL2 within Site II of C5aR1.

In an embodiment, the antibody molecule contacts (e.g., binds, or substantially binds, to) one or more residues, or one or more regions, of Site I and/or Site II of C5aR1 (e.g., human C5aR1). In an embodiment, the antibody molecule binds to an epitope comprising ECL2 of C5aR1 or a portion thereof (e.g., a Site II epitope). In an embodiment, the antibody molecule binds to an epitope comprising ECL1 of C5aR1 or a portion thereof (e.g., a Site II epitope). In an embodiment, the antibody molecule binds to an epitope comprising ECL3 of C5aR1 or a portion thereof (e.g., a Site II epitope). In an embodiment, the antibody molecule binds to an epitope comprising a sulfated N-terminal region (e.g., a sulfated Site I epitope). In an embodiment, the antibody molecule binds to an epitope comprising a non-sulfated N-terminal region (e.g., a non-sulfated Site I epitope).

In an embodiment, the antibody molecule binds to one or more epitopes described herein. In an embodiment, the antibody molecule binds, or substantially binds, to one or more, e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, or all, residues (e.g., consecutive residues) within a region of human C5aR1 Site I sequence, e.g., comprising SEQ ID NO: 1449 or 1452. In an embodiment, the antibody molecule binds, or substantially binds, to one or more, e.g., 2, 3, 4, 5, 6, 7, 8, 9, 10, 11, 12, 13, 14, 15, 16, 17, 18, 19, 20, 21, 22, 23, 24, 25, or all, residues (e.g., consecutive residues) within a region of human C5aR1 Site II sequence, e.g., comprising any of SEQ ID NOs: 1450, 1453, 1454, or 1455. In an embodiment, the antibody molecule binds, or substantially binds, to one or more, e.g., 2, 3, 4, 5, 6, 7, 8, 9, 10, 11, 12, 13, 14, 15, 16, 17, 18, 19, or more, residues (e.g., consecutive residues) within a core epitope region of human C5aR1 Site II sequence, e.g., comprising amino acids 1-20 of SEQ ID NO: 1450. In an embodiment, the antibody molecule binds, or substantially binds, to one or more, e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, or all, residues (e.g., consecutive residues) within a region of human C5aR1 Site I sequence, e.g., comprising SEQ ID NO: 1449 or 1452; and one or more, e.g., 2, 3, 4, 5, 6, 7, 8, 9, 10, 11, 12, 13, 14, 15, 16, 17, 18, 19, 20, 21, 22, 23, 24, 25, or all, residues (e.g., consecutive residues) within a region of human C5aR1 Site II sequence, e.g., comprising any of SEQ ID NOs: 1450, 1453, 1454, or 1455. In an embodiment, the antibody molecule binds, or substantially binds, to one or more, e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, or all, residues (e.g., consecutive residues) within a region of human C5aR1 Site I sequence, e.g., comprising SEQ ID NO: 1449 or 1452; and one or more, e.g., 2, 3, 4, 5, 6, 7, 8, 9, 10, 11, 12, 13, 14, 15, 16, 17, 18, 19, 20, or more, residues (e.g., consecutive residues) within a core epitope region of human C5aR1 Site II sequence, e.g., comprising amino acids 1-20 of SEQ ID NO: 1450.

Antibody Molecules

Disclosed herein are antibody molecules or antigen binding fragments that bind to C5aR1. As described above the antibodies in this disclosure inhibit binding of C5a to C5aR1, leading to inhibition of diseases associated with dysfunctional C5a/C5aR1 axis pathway, such as ANCA-associated vasculitis.

As used herein, the term "antibody molecule" refers to a protein, e.g., an immunoglobulin chain or a fragment thereof, comprising at least one immunoglobulin variable domain sequence. The term "antibody molecule" includes, for example, full-length, mature antibodies and antigen-binding fragments of an antibody. For example, an antibody molecule can include a heavy (H) chain variable domain sequence (abbreviated herein as VH), and a light (L) chain variable domain sequence (abbreviated herein as VL). In another example, an antibody molecule includes two heavy (H) chain variable domain sequences and two light (L) chain variable domain sequence, thereby forming two antigen binding sites, such as Fab, Fab', F(ab')2, Fc, Fd, Fd', Fv, single chain antibodies (scFv for example), single variable domain antibodies, diabodies (Dab) (bivalent and bispecific), and chimeric (e.g., humanized) antibodies, which may be produced by the modification of whole antibodies or those synthesized de novo using recombinant DNA technologies. These functional antibody fragments retain the ability to selectively bind with their respective antigen or receptor. Antibodies and antibody fragments can be from any class of antibodies including, but not limited to, IgG, IgA, IgM, IgD, and IgE, and from any subclass (e.g., IgG1, IgG2, IgG3, and IgG4) of antibodies. The antibody molecules can be monoclonal or polyclonal. The antibody molecule can also be a human, humanized, CDR-grafted, or in vitro generated antibody. The antibody molecule can have a heavy chain constant region chosen from, e.g., IgG1, IgG2 (for e.g., SEQ ID NO: 1444, SEQ ID NO: 1445, SEQ ID NO: 1446, SEQ ID NO: 1447), IgG3, or IgG4. The antibody molecule can also have a light chain chosen from, e.g., kappa or lambda. The term "immunoglobulin" (Ig) is used interchangeably with the term "antibody" herein.

Examples of antigen-binding fragments include: (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a diabody (dAb) fragment, which consists of a VH domain; (vi) a camelid or camelized variable domain; (vii) a single chain Fv (scFv), see e.g., Bird et al. (1988) *Science* 242:423-426; and Huston et al. (1988) *Proc. Natl. Acad. Sci. USA* 85:5879-5883); (viii) a single domain antibody. These antibody fragments may be obtained using any suitable method, including several conventional techniques known to those with skill in the art, and the fragments can be screened for utility in the same manner as are intact antibodies.

The term "antibody" includes intact molecules as well as functional fragments thereof. Constant regions of the antibodies can be altered, e.g., mutated, to modify the properties of the antibody (e.g., to increase or decrease one or more of: Fc receptor binding, antibody glycosylation, the number of cysteine residues, effector cell function, or complement function).

The antibody molecule can be a single chain antibody. A single-chain antibody (scFv) may be engineered (see, for example, Colcher, D. et al. (1999) *Ann NY Acad Sci* 880: 263-80; and Reiter, Y. (1996) *Clin Cancer Res* 2:245-52). The single chain antibody can be dimerized or multimerized to generate multivalent antibodies having specificities for different epitopes of the same target protein.

The antibody molecules disclosed herein can also be single domain antibodies. Single domain antibodies can include antibodies whose complementary determining regions are part of a single domain polypeptide. Examples include, but are not limited to, heavy chain antibodies, antibodies naturally devoid of light chains, single domain antibodies derived from conventional 4-chain antibodies, engineered antibodies and single domain scaffolds other than those derived from antibodies. Single domain antibodies may be any of the art, or any future single domain antibodies. Single domain antibodies may be derived from any species including, but not limited to mouse, human, camel, llama, fish, shark, goat, rabbit, and bovine. According to some aspects, a single domain antibody is a naturally occurring single domain antibody known as heavy chain antibody devoid of light chains Such single domain antibodies are disclosed in WO 94/04678, for example. For clarity reasons, this variable domain derived from a heavy chain antibody naturally devoid of light chain is known herein as a VHH or nanobody to distinguish it from the conventional VH of four chain immunoglobulins. Such a VHH molecule can be derived from antibodies raised in Camelidae species, for example in camel, llama, dromedary, alpaca and guanaco. Other species besides Camelidae may produce heavy chain antibodies naturally devoid of light chain; such VHHs are also contemplated.

The VH and VL regions can be subdivided into regions of hypervariability, termed "complementarity determining regions" (CDR), interspersed with regions that are more conserved, termed "framework regions" (FR or FW). The terms "complementarity determining region," and "CDR," as used herein refer to the sequences of amino acids within antibody variable regions which confer antigen specificity and binding affinity. As used herein, the terms "framework," "FW" and "FR" are used interchangeably.

The extent of the framework region and CDRs has been precisely defined by a number of methods (see, Kabat, E. A., et al. (1991) Sequences of Proteins of Immunological Interest, Fifth Edition, U.S. Department of Health and Human Services, NIH Publication No. 91-3242; Chothia, C. et al. (1987) *J. Mol. Biol.* 196:901-917; and the AbM definition used by Oxford Molecular's AbM antibody modeling software. See, generally, e.g., Protein Sequence and Structure Analysis of Antibody Variable Domains. In: Antibody Engineering Lab Manual (Ed.: Duebel, S. and Kontermann, R., Springer-Verlag, Heidelberg). In an embodiment, the following definitions are used: AbM definition of CDR1 of the heavy chain variable domain and Kabat definitions for the other CDRs. In an embodiment, Kabat definitions are used for all CDRs. In addition, embodiments described with respect to Kabat or AbM CDRs may also be implemented using Chothia hypervariable loops. Each VH and VL typically includes three CDRs and four FRs, arranged from amino-terminus to carboxy-terminus in the following order: FR1, CDR1, FR2, CDR2, FR3, CDR3, and FR4.

As used herein, an "immunoglobulin variable domain sequence" refers to an amino acid sequence which can form the structure of an immunoglobulin variable domain. For example, the sequence may include all or part of the amino acid sequence of a naturally-occurring variable domain. For example, the sequence may or may not include one, two, or more N- or C-terminal amino acids, or may include other alterations that are compatible with formation of the protein structure.

The term "antigen-binding region" refers to the part of an antibody molecule that comprises determinants that form an interface that binds to an antigen, e.g., C5aR1, or an epitope thereof. With respect to proteins (or protein mimetics), the antigen-binding region typically includes one or more loops (of at least, e.g., four amino acids or amino acid mimics) that form an interface that binds to the antigen, e.g., C5aR1. Typically, the antigen-binding region of an antibody molecule includes at least one or two CDRs and/or hypervariable loops, or more typically at least three, four, five or six CDRs and/or hypervariable loops.

The terms "compete" or "cross-compete" are used interchangeably herein to refer to the ability of an antibody molecule to interfere with binding of an anti-C5aR1 antibody molecule, e.g., an anti-C5aR1 antibody molecule provided herein, to a target, e.g., C5aR1. The interference with binding can be direct or indirect (e.g., through an allosteric modulation of the antibody molecule or the target). The extent to which an antibody molecule is able to interfere with the binding of another antibody molecule to the target, and therefore whether it can be said to compete, can be determined using a competition binding assay, for example, a FACS assay, an ELISA or BIACORE assay. In an embodiment, a competition binding assay is a quantitative competition assay. In an embodiment, a first anti-C5aR1 antibody molecule is said to compete for binding to the target with a second anti-C5aR1 antibody molecule when the binding of the first antibody molecule to the target is reduced by 10% or more, e.g., 20% or more, 30% or more, 40% or more, 50% or more, 55% or more, 60% or more, 65% or more, 70% or more, 75% or more, 80% or more, 85% or more, 90% or more, 95% or more, 98% or more, 99% or more in a competition binding assay (e.g., a competition assay described herein).

The terms "monoclonal antibody" or "monoclonal antibody composition" as used herein refer to a preparation of antibody molecules of single molecular composition. A monoclonal antibody composition displays a single binding specificity and affinity for a particular epitope. A monoclonal antibody can be made by hybridoma technology or by methods that do not use hybridoma technology (e.g., recombinant methods).

An "effectively human" protein is a protein that does not evoke a neutralizing antibody response, e.g., the human anti-murine antibody (HAMA) response. HAMA can be problematic in a number of circumstances, e.g., if the antibody molecule is administered repeatedly, e.g., in treatment of a chronic or recurrent disease condition. A HAMA response can make repeated antibody administration potentially ineffective because of an increased antibody clearance from the serum (see, e.g., Saleh et al., *Cancer Immunol. Immunother.*, 32:180-190 (1990)) and also because of potential allergic reactions (see, e.g., LoBuglio et al., *Hybridoma*, 5:5117-5123 (1986)).

The antibody molecule can be a polyclonal or a monoclonal antibody. In an embodiment, the antibody can be recombinantly produced, e.g., produced by any suitable phage display or combinatorial methods.

Various phage display and combinatorial methods for generating antibodies are known in the art (as described in, e.g., Ladner et al. U.S. Pat. No. 5,223,409; Kang et al. International Publication No. WO 92/18619; Dower et al. International Publication No. WO 91/17271; Winter et al.

International Publication WO 92/20791; Markland et al. International Publication No. WO 92/15679; Breitling et al. International Publication WO 93/01288; McCafferty et al. International Publication No. WO 92/01047; Garrard et al. International Publication No. WO 92/09690; Ladner et al. International Publication No. WO 90/02809; Fuchs et al. (1991) *Bio/Technology* 9:1370-1372; Hay et al. (1992) *Hum Antibod Hybridomas* 3:81-85; Huse et al. (1989) *Science* 246:1275-1281; Griffths et al. (1993) *EMBO J* 12:725-734; Hawkins et al. (1992) *J Mol Biol* 226:889-896; Clackson et al. (1991) *Nature* 352:624-628; Gram et al. (1992) *PNAS* 89:3576-3580; Garrad et al. (1991) *Bio/Technology* 9:1373-1377; Hoogenboom et al. (1991) *Nuc Acid Res* 19:4133-4137; and Barbas et al. (1991) *PNAS* 88:7978-7982, the contents of all of which are incorporated by reference herein).

In an embodiment, the antibody molecule is a fully human antibody (e.g., an antibody made in a mouse which has been genetically engineered to produce an antibody from a human immunoglobulin sequence), or a non-human antibody, e.g., a rodent (mouse or rat), goat, primate (e.g., monkey), camel antibody. In an embodiment, the non-human antibody is a rodent (mouse or rat antibody). Methods of producing rodent antibodies are known in the art.

Human monoclonal antibodies can be generated using transgenic mice carrying the human immunoglobulin genes rather than the mouse system. Splenocytes from these transgenic mice immunized with the antigen of interest are used to produce hybridomas that secrete human mAbs with specific affinities for epitopes from a human protein (see e.g., Wood et al. International Application WO 91/00906, Kucherlapati et al. PCT publication WO 91/10741; Lonberg et al. International Application WO 92/03918; Kay et al. International Application 92/03917; Lonberg, N. et al. 1994 *Nature* 368:856-859; Green, L. L. et al. 1994 *Nature Genet.* 7:13-21; Morrison, S. L. et al. 1994 *Proc. Natl. Acad. Sci. USA* 81:6851-6855; Bruggeman et al. 1993 Year *Immunol* 7:33-40; Tuaillon et al. 1993 *PNAS* 90:3720-3724; Bruggeman et al. 1991 *Eur J Immunol* 21:1323-1326).

An antibody can be one in which the variable region, or a portion thereof, e.g., the CDRs, are generated in a non-human organism, e.g., a rat or mouse. Chimeric, CDR-grafted, and humanized antibodies are within the invention. Antibodies generated in a non-human organism, e.g., a rat or mouse, and then modified, e.g., in the variable framework or constant region, to decrease antigenicity in a human are within the invention.

Chimeric antibodies can be produced by any suitable recombinant DNA technique. Several are known in the art (see Robinson et al., International Patent Application Publication No. WO1987/002671; Akira, et al., European Patent Application Publication No. 184,187; Taniguchi, M., European Patent Application Publication No. 171,496; Morrison et al., European Patent Application Publication No. 173,494; Neuberger et al., International Patent Application Publication No. WO 86/01533; Cabilly et al. U.S. Pat. No. 4,816,567; Cabilly et al., European Patent Application Publication No. 125,023; Better et al. (1988 *Science* 240:1041-1043); Liu et al. (1987) *PNAS* 84:3439-3443; Liu et al., 1987, *J. Immunol.* 139:3521-3526; Sun et al. (1987) *PNAS* 84:214-218; Nishimura et al., 1987, *Canc. Res.* 47:999-1005; Wood et al. (1985) *Nature* 314:446-449; and Shaw et al., 1988, *J. Natl Cancer Inst.* 80:1553-1559).

A humanized or CDR-grafted antibody will have at least one or two but generally all three recipient CDRs (of heavy and or light immunoglobulin chains) replaced with a donor CDR. The antibody may be replaced with at least a portion of a non-human CDR or only some of the CDRs may be replaced with non-human CDRs. It is only necessary to replace the number of CDRs required for binding of the humanized antibody to lipopolysaccharide. In an embodiment, the donor will be a rodent antibody, e.g., a rat or mouse antibody, and the recipient will be a human framework or a human consensus framework. Typically, the immunoglobulin providing the CDRs is called the "donor" and the immunoglobulin providing the framework is called the "acceptor." In an embodiment, the donor immunoglobulin is a non-human (e.g., rodent). The acceptor framework is typically a naturally-occurring (e.g., a human) framework or a consensus framework, or a sequence about 85% or higher, e.g., 90%, 95%, 99% or higher identical thereto.

As used herein, the term "consensus sequence" refers to the sequence formed from the most frequently occurring amino acids (or nucleotides) in a family of related sequences (See e.g., Winnaker, From Genes to Clones (Verlagsgesellschaft, Weinheim, Germany 1987). In a family of proteins, each position in the consensus sequence is occupied by the amino acid occurring most frequently at that position in the family. If two amino acids occur equally frequently, either can be included in the consensus sequence. A "consensus framework" refers to the framework region in the consensus immunoglobulin sequence.

As described above, the antibody molecules or antigen binding fragments thereof, can bind C5aR1 at specific residues. For example, in some embodiments, the antibody molecules or antigen binding fragments thereof can bind C5aR1 at Site I (SEQ ID NO: 1449 or SEQ ID NO: 1452) and/or Site II (SEQ ID NO: 1448).

In some embodiments, the C5aR1 antibodies disclosed herein show antagonistic activity against C5a-mediated C5aR1 signaling, e.g., resulting in inhibited calcium mobilization and chemotaxis of neutrophils in the presence of C5a. Antibodies against Site I and antibodies against Site II were both identified and selected for their ability to inhibit C5a binding to C5aR1. Approximately 61 C5aR1 antagonistic antibodies were evaluated and were sequenced. The sequences are summarized in Tables 1, 2 and 3.

In some embodiments, the antibodies presented herein, comprise AYAMS (SEQ ID NO: 1456), SISTGGNTY (SEQ ID NO: 1457), and GYQRFSGFAY (SEQ ID NO: 1458) or a variant thereof. In some cases, SEQ ID NOs: 1456-1458 are referred to as CDRs. In some embodiments the antibody variant, comprises a sequence that differs by no more than 5, 4, 3, 2 or 1 amino acids from amino acids of SEQ ID NOs: 1456, 1457 and/or 1458. In some embodiments, the antibody comprising SEQ ID NOs: 1456, 1457 and/or 1458, bind Site I defined by SEQ ID NO: 1449 or SEQ ID NO: 1452. In some embodiments, SEQ ID NOs: 1456, 1457 and/or 1458 are part of HCDR.

In some embodiments, the antibodies presented herein, comprise RSSQSLVHSNGNTYLN (SEQ ID NO: 1459), KVSNRLS (SEQ ID NO: 1460), and SQSTHVPYT (SEQ ID NO: 1461). In some cases, SEQ ID NOs: 1459-1461 are referred to as CDRs. In some embodiments the antibody variant, comprises a sequence that differs by no more than 5, 4, 3, 2 or 1 amino acids from amino acids of SEQ ID NOs: 1459, 1460 and/or 1461. In some embodiments, the antibody comprising SEQ ID NOs: 1459, 1460 and/or 1461, bind Site II defined by SEQ ID NO: 1449 or SEQ ID NO: 1452. In some embodiments, SEQ ID NOs: 1459, 1460 and/or 1461 are part of LCDR.

In some embodiments, the antibodies presented herein, comprise NYWMH (SEQ ID NO: 1462), YLNPSSGYTKY (SEQ ID NO: 1463), and SGGDNYGNPYYFDR (SEQ ID NO: 1464) or a variant thereof. In some cases, SEQ ID NOs: 1462-1464 are referred to as CDRs. In some embodiments the antibody variant, comprises a sequence that differs by no more than 5, 4, 3, 2 or 1 amino acids from amino acids of SEQ ID NOs: 1462, 1463 and/or 1464. In some embodiments, the antibody comprising SEQ ID NOs: 1462, 1463 and/or 1464, bind Site II defined by SEQ ID NO: 1450 or SEQ ID NO: 1452. In some embodiments, SEQ ID NOs: 1462, 1463 and/or 1464 are part of HCDR.

In some embodiments, the antibodies presented herein, comprise VHSNGNTYLH (SEQ ID NO: 1465), YLNPSSGYTKY (SEQ ID NO: 1466), and SGGDNYG-NPYYFDR (SEQ ID NO: 1467) or a variant thereof. In some cases, SEQ ID NOs: 1466-1467 are referred to as CDRs. In some embodiments the antibody variant, comprises a sequence that differs by no more than 5, 4, 3, 2 or 1 amino acids from amino acids of SEQ ID NOs: 1465, 1466 and/or 1467. In some embodiments, the antibody comprising SEQ ID NOs: 1465, 1466 and/or 1467, bind Site II defined by SEQ ID NO: 1450 or SEQ ID NO: 1452. In some embodiments, SEQ ID NOs: 1465, 1466 and/or 1467 are part of LCDR.

In some embodiments, the anti-C5aR1 antibody comprises a Fab, linked to a Fc domain, comprising two heavy chains and two light chains. Each heavy chain and light chain comprises a heavy chain variable region (HCVR or VH) and a light chain variable region (LCVR or VL). The heavy chain and light chain also comprise three heavy chain complementarity determining regions (HCDR1, HCDR2 and HCDR3) and three light chain complementarity determining regions (LCDR1, LCDR2 and LCDR3).

In some embodiments, the antibody molecule capable of binding to complement component 5a receptor 1 (C5aR1), is Ab583, comprising a HCDR1 comprising an amino acid sequence of SEQ ID NO: 656, a HCDR2 comprising an amino acid sequence of SEQ ID NO: 776, and a HCDR3 comprising an amino acid sequence of SEQ ID NO: 896; and a LCDR1 comprising an amino acid sequence of SEQ ID NO: 715, a LCDR2 comprising an amino acid sequence of SEQ ID NO: 835, and a LCDR3 comprising an amino acid sequence of SEQ ID NO: 955 or comprises a sequence that differs by no more than 5, 4, 3, 2 or 1 amino acids from amino acids of SEQ ID Nos: 656, 776, 896, 715, 955 and/or 835. In some embodiments, the antibody molecule capable of binding to complement component 5a receptor 1 (C5aR1), is Ab583, comprising a variable heavy chain comprises an amino acid sequence of SEQ ID NO: 536; or has at least 70, 80, 90, 95, 96, 97, 98, 99, or 100% identity with, the amino acid sequence of SEQ ID NO: 536. In some embodiments, the antibody molecule capable of binding to complement component 5a receptor 1 (C5aR1), is Ab583, comprising a variable light chain comprises amino acid sequence of SEQ ID NO: 595 or has at least 70, 80, 90, 95, 96, 97, 98, 99, or 100% identity with, the amino acid sequence of SEQ ID NO: 595. In some embodiments, Ab583 can bind C5aR1 at Site I (SEQ ID NO: 1449 or SEQ ID NO: 1452).

In some embodiments, the antibody molecule capable of binding to complement component 5a receptor 1 (C5aR1), is the antibody Ab66, comprising a HCDR1 comprising an amino acid sequence of SEQ ID NO: 603, a HCDR2 comprising an amino acid sequence of SEQ ID NO: 723; and a HCDR3 comprising an amino acid sequence of SEQ ID NO: 843; and a LCDR1 comprising an amino acid sequence of SEQ ID NOs: 663, a LCDR2 comprising an amino acid sequence of SEQ ID NOs: 783, and a LCDR3 comprising an amino acid sequence of SEQ ID NOs: 903; or comprises a sequence that differs by no more than 5, 4, 3, 2 or 1 amino acids from amino acids of SEQ ID Nos: 603, 723, 843, 663, 783 and/or 903. In some embodiments, the antibody molecule capable of binding to complement component 5a receptor 1 (C5aR1), is Ab66, comprising a variable heavy chain comprises amino acid sequence of SEQ ID NO: 483, or has at least 70, 80, 90, 95, 96, 97, 98, 99, or 100% identity with, the amino acid sequence of SEQ ID NO: 483. In some embodiments, the antibody molecule capable of binding to complement component 5a receptor 1 (C5aR1), is Ab66, comprising a variable light chain comprises amino acid sequence of SEQ ID NO: 543, or has at least 70, 80, 90, 95, 96, 97, 98, 99, or 100% identity with, the amino acid sequence of SEQ ID NO: 543. In some embodiments, Ab66 can bind C5aR1 at Site I (SEQ ID NO: 1449 or SEQ ID NO: 1452).

In some embodiments, the antibody molecule capable of binding to complement component 5a receptor 1 (C5aR1), is the antibody Ab322, comprising a HCDR1 comprising an amino acid sequence of SEQ ID NO: 611, a HCDR2 comprising an amino acid sequence of SEQ ID NO: 731; and a HCDR3 comprising an amino acid sequence of SEQ ID NO: 851; and a LCDR1 comprising an amino acid sequence of SEQ ID NOs: 671, a LCDR2 comprising an amino acid sequence of SEQ ID NOs: 791, and a LCDR3 comprising an amino acid sequence of SEQ ID NOs: 911; or comprises a sequence that differs by no more than 5, 4, 3, 2 or 1 amino acids from amino acids of SEQ ID Nos: 611, 731, 851, 671, 791 and/or 911. In some embodiments, the antibody molecule capable of binding to complement component 5a receptor 1 (C5aR1), is Ab322, comprising a variable heavy chain comprises amino acid sequence of SEQ ID NO: 491, or has at least 70, 80, 90, 95, 96, 97, 98, 99, or 100% identity with, the amino acid sequence of SEQ ID NO: 491. In some embodiments, the antibody molecule capable of binding to complement component 5a receptor 1 (C5aR1), is Ab322, comprising a variable light chain comprises amino acid sequence of SEQ ID NO: 551, or has at least 70, 80, 90, 95, 96, 97, 98, 99, or 100% identity with, the amino acid sequence of SEQ ID NO: 551. In some embodiments, Ab322 can bind C5aR1 at Site I (SEQ ID NO: 1449 or SEQ ID NO: 1452).

In some embodiments, the antibody molecule capable of binding to complement component 5a receptor 1 (C5aR1), is the antibody Ab329, comprising a HCDR1 comprising an amino acid sequence of SEQ ID NO: 612, an HCDR2 comprising an amino acid sequence of SEQ ID NO: 732, and an HCDR3 comprising and amino acid sequence of SEQ ID NO: 852, a LCDR1 comprising an amino acid sequence of SEQ ID NO: 672, a LCDR2 comprising an amino acid sequence of SEQ ID NO: 792, and a LCDR3 comprising an amino acid sequence of SEQ ID NO: 912; or comprises a sequence that differs by no more than 5, 4, 3, 2 or 1 amino acids from amino acids of SEQ ID Nos: 612, 732, 852, 672, 792 and/or 912. In some embodiments, the antibody molecule capable of binding to complement component 5a receptor 1 (C5aR1), is Ab329, comprising a variable heavy chain comprises amino acid sequence of SEQ ID NO: 492, or has at least 70, 80, 90, 95, 96, 97, 98, 99, or 100% identity with, the amino acid sequence of SEQ ID NO: 492. In some embodiments, the antibody molecule capable of binding to complement component 5a receptor 1 (C5aR1), is Ab329, comprising a variable light chain comprises amino acid sequence of SEQ ID NO: 552, or has at least 70, 80, 90, 95, 96, 97, 98, 99, or 100% identity with, the amino acid sequence of SEQ ID NO: 552. In some embodiments, Ab329 can bind C5aR1 at Site II (SEQ ID NO: 1450).

In some embodiments, the antibody molecule capable of binding to complement component 5a receptor 1 (C5aR1), is the antibody Ab336v2, comprises a HCDR1 comprising an amino acid sequence of SEQ ID NOs: 617, a HCDR2 comprising an amino acid sequence of SEQ ID NOs: 737 and a HCDR3 comprising an amino acid sequence of SEQ ID NOs: 857; and a LCDR1 comprising an amino acid sequence of SEQ ID NOs: 677, a LCDR2 comprising an amino acid sequence of SEQ ID NOs: 797, and a LCDR3 comprising an amino acid sequence of SEQ ID NOs: 917; or comprises a sequence that differs by no more than 5, 4, 3, 2 or 1 amino acids from amino acids of SEQ ID Nos: 617, 737, 857, 677, 797 and/or 917. In some embodiments, the antibody molecule capable of binding to complement component 5a receptor 1 (C5aR1), is Ab336v2, comprising a variable heavy chain comprises amino acid sequence of SEQ ID NO: 497, or has at least 70, 80, 90, 95, 96, 97, 98, 99, or 100% identity with, the amino acid sequence of SEQ ID NO: 497. In some embodiments, the antibody molecule capable of binding to complement component 5a receptor 1 (C5aR1), is Ab336v2, comprising a variable light chain comprises amino acid sequence of SEQ ID NO: 557, or has at least 70, 80, 90, 95, 96, 97, 98, 99, or 100% identity with, the amino acid sequence of SEQ ID NO: 557. In some embodiments, Ab336v2 can bind C5aR1 at Site II) (SEQ ID NO: 1450).

In some embodiments, the antibody molecule capable of binding to complement component 5a receptor 1 (C5aR1), is the antibody Ab11v2, comprises a HCDR1 comprising an amino acid sequence of SEQ ID NOs: SEQ ID NOs: 602, a HCDR2 comprising an amino acid sequence of SEQ ID NOs: 722; and a HCDR3 comprising an amino acid sequence of SEQ ID NOs: 842; and a LCDR1 comprising an amino acid sequence of SEQ ID NOs: 662, a LCDR2 comprising an amino acid sequence of SEQ ID NOs: 782, and a LCDR3 comprising an amino acid sequence of SEQ ID NOs: 902 or comprises a sequence that differs by no more than 5, 4, 3, 2 or 1 amino acids from amino acids of SEQ ID Nos: 602, 722, 842, 662, 782 and/or 902. In some embodiments, the antibody molecule capable of binding to complement component 5a receptor 1 (C5aR1), is Ab11v2, comprising a variable heavy chain with amino acid sequence of SEQ ID NO: 482, or has at least 70, 80, 90, 95, 96, 97, 98, 99, or 100% identity with, the amino acid sequence of SEQ ID NO: 482. In some embodiments, the antibody molecule capable of binding to complement component 5a receptor 1 (C5aR1), is Ab11v2, comprising a variable light chain with comprises amino acid sequence of SEQ ID NO: 542, or has at least 70, 80, 90, 95, 96, 97, 98, 99, or 100% identity with, the amino acid sequence of SEQ ID NO: 542. In some embodiments, Ab11v2 can bind C5aR1 at Site II (SEQ ID NO: 1450).

In some embodiments, the antibody molecule capable of binding to complement component 5a receptor 1 (C5aR1), is Ab583, comprising a HCDR1 comprising an amino acid sequence of SEQ ID NO: 176, a HCDR2 comprising an amino acid sequence of SEQ ID NO: 296, and a HCDR3 comprising an amino acid sequence of SEQ ID NO: 416; and a LCDR1 comprising an amino acid sequence of SEQ ID NO: 235, a LCDR2 comprising an amino acid sequence of SEQ ID NO: 355, and a LCDR3 comprising an amino acid sequence of SEQ ID NO: 475 or comprises a sequence that differs by no more than 5, 4, 3, 2 or 1 amino acids from amino acids of SEQ ID Nos: 176, 296, 416, 235, 355 and/or 475. In some embodiments, the antibody molecule capable of binding to complement component 5a receptor 1 (C5aR1), is Ab583, comprising a variable heavy chain comprises an amino acid sequence of SEQ ID NO: 56; or has at least 70, 80, 90, 95, 96, 97, 98, 99, or 100% identity with, the amino acid sequence of SEQ ID NO: 56. In some embodiments, the antibody molecule capable of binding to complement component 5a receptor 1 (C5aR1), is Ab583, comprising a variable light chain comprises amino acid sequence of SEQ ID NO: 115 or has at least 70, 80, 90, 95, 96, 97, 98, 99, or 100% identity with, the amino acid sequence of SEQ ID NO: 115. In some embodiments, Ab583 can bind C5aR1 at Site I (SEQ ID NO: 1449 or SEQ ID NO: 1452).

In some embodiments, the antibody molecule capable of binding to complement component 5a receptor 1 (C5aR1), is the antibody Ab66, comprising a HCDR1 comprising an amino acid sequence of SEQ ID NO: 123, a HCDR2 comprising an amino acid sequence of SEQ ID NO: 243; and a HCDR3 comprising an amino acid sequence of SEQ ID NO: 363; and a LCDR1 comprising an amino acid sequence of SEQ ID NOs: 183, a LCDR2 comprising an amino acid sequence of SEQ ID NOs: 303, and a LCDR3 comprising an amino acid sequence of SEQ ID NOs: 423; or comprises a sequence that differs by no more than 5, 4, 3, 2 or 1 amino acids from amino acids of SEQ ID Nos: 123, 243, 363, 183, 303 and/or 423. In some embodiments, the antibody molecule capable of binding to complement component 5a receptor 1 (C5aR1), is Ab66, comprising a variable heavy chain comprises amino acid sequence of SEQ ID NO: 3, or has at least 70, 80, 90, 95, 96, 97, 98, 99, or 100% identity with, the amino acid sequence of SEQ ID NO: 3. In some embodiments, the antibody molecule capable of binding to complement component 5a receptor 1 (C5aR1), is Ab66, comprising a variable light chain comprises amino acid sequence of SEQ ID NO: 63, or has at least 70, 80, 90, 95, 96, 97, 98, 99, or 100% identity with, the amino acid sequence of SEQ ID NO: 63. In some embodiments, Ab66 can bind C5aR1 at Site I (SEQ ID NO: 1449 or SEQ ID NO: 1452).

In some embodiments, the antibody molecule capable of binding to complement component 5a receptor 1 (C5aR1), is the antibody Ab322, comprising a HCDR1 comprising an amino acid sequence of SEQ ID NO: 131, a HCDR2 comprising an amino acid sequence of SEQ ID NO: 251; and a HCDR3 comprising an amino acid sequence of SEQ ID NO: 371; and a LCDR1 comprising an amino acid sequence of SEQ ID NOs: 191, a LCDR2 comprising an amino acid sequence of SEQ ID NOs: 311, and a LCDR3 comprising an amino acid sequence of SEQ ID NOs: 431; or comprises a sequence that differs by no more than 5, 4, 3, 2 or 1 amino acids from amino acids of SEQ ID Nos: 131, 251, 371, 191, 311 and/or 431. In some embodiments, the antibody molecule capable of binding to complement component 5a receptor 1 (C5aR1), is Ab322, comprising a variable heavy chain comprises amino acid sequence of SEQ ID NO: 11, or has at least 70, 80, 90, 95, 96, 97, 98, 99, or 100% identity with, the amino acid sequence of SEQ ID NO: 11. In some embodiments, the antibody molecule capable of binding to complement component 5a receptor 1 (C5aR1), is Ab322, comprising a variable light chain comprises amino acid sequence of SEQ ID NO: 71, or has at least 70, 80, 90, 95, 96, 97, 98, 99, or 100% identity with, the amino acid sequence of SEQ ID NO: 71. In some embodiments, Ab322 can bind C5aR1 at Site I (SEQ ID NO: 1449 or SEQ ID NO: 1452).

In some embodiments, the antibody molecule capable of binding to complement component 5a receptor 1 (C5aR1), is the antibody Ab329, comprising a HCDR1 comprising an amino acid sequence of SEQ ID NO: 132, an HCDR2 comprising an amino acid sequence of SEQ ID NO: 252, and an HCDR3 comprising and amino acid sequence of SEQ ID NO: 372, a LCDR1 comprising an amino acid sequence of SEQ ID NO: 192, a LCDR2 comprising an amino acid sequence of SEQ ID NO: 312, and a LCDR3 comprising an amino acid sequence of SEQ ID NO: 432; or comprises a sequence that differs by no more than 5, 4, 3, 2 or 1 amino acids from amino acids of SEQ ID Nos: 132, 252, 372, 192, 312 and/or 432. In some embodiments, the antibody molecule capable of binding to complement component 5a receptor 1 (C5aR1), is Ab329, comprising a variable heavy chain comprises amino acid sequence of SEQ ID NO: 12, or has at least 70, 80, 90, 95, 96, 97, 98, 99, or 100% identity with, the amino acid sequence of SEQ ID NO: 12. In some embodiments, the antibody molecule capable of binding to complement component 5a receptor 1 (C5aR1), is Ab329, comprising a variable light chain comprises amino acid sequence of SEQ ID NO: 72, or has at least 70, 80, 90, 95, 96, 97, 98, 99, or 100% identity with, the amino acid sequence of SEQ ID NO: 72. In some embodiments, Ab329 can bind C5aR1 at Site II (SEQ ID NO: 1450).

In some embodiments, the antibody molecule capable of binding to complement component 5a receptor 1 (C5aR1), is the antibody Ab336v2, comprises a HCDR1 comprising an amino acid sequence of SEQ ID NOs: 137, a HCDR2 comprising an amino acid sequence of SEQ ID NOs: 257 and a HCDR3 comprising an amino acid sequence of SEQ ID NOs: 377; and a LCDR1 comprising an amino acid sequence of SEQ ID NOs: 197, a LCDR2 comprising an amino acid sequence of SEQ ID NOs: 317, and a LCDR3 comprising an amino acid sequence of SEQ ID NOs: 437; or comprises a sequence that differs by no more than 5, 4, 3, 2 or 1 amino acids from amino acids of SEQ ID Nos: 137, 257, 377, 197, 317 and/or 437. In some embodiments, the antibody molecule capable of binding to complement component 5a receptor 1 (C5aR1), is Ab336v2, comprising a variable heavy chain comprises amino acid sequence of SEQ ID NO: 17, or has at least 70, 80, 90, 95, 96, 97, 98, 99, or 100% identity with, the amino acid sequence of SEQ ID NO: 17. In some embodiments, the antibody molecule capable of binding to complement component 5a receptor 1 (C5aR1), is Ab336v2, comprising a variable light chain comprises amino acid sequence of SEQ ID NO: 77, or has at least 70, 80, 90, 95, 96, 97, 98, 99, or 100% identity with, the amino acid sequence of SEQ ID NO: 77. In some embodiments, Ab336v2 can bind C5aR1 at Site II) (SEQ ID NO: 1450).

In some embodiments, the antibody molecule capable of binding to complement component 5a receptor 1 (C5aR1), is the antibody Ab11v2, comprises a HCDR1 comprising an amino acid sequence of SEQ ID NOs: SEQ ID NOs: 122, a HCDR2 comprising an amino acid sequence of SEQ ID NOs: 242; and a HCDR3 comprising an amino acid sequence of SEQ ID NOs: 362; and a LCDR1 comprising an amino acid sequence of SEQ ID NOs: 182, a LCDR2 comprising an amino acid sequence of SEQ ID NOs: 302, and a LCDR3 comprising an amino acid sequence of SEQ ID NOs: 422 or comprises a sequence that differs by no more than 5, 4, 3, 2 or 1 amino acids from amino acids of SEQ ID Nos: 122, 242, 362, 182, 302 and/or 422. In some embodiments, the antibody molecule capable of binding to complement component 5a receptor 1 (C5aR1), is Ab11v2, comprising a variable heavy chain with amino acid sequence of SEQ ID NO: 2, or has at least 70, 80, 90, 95, 96, 97, 98, 99, or 100% identity with, the amino acid sequence of SEQ ID NO: 2. In some embodiments, the antibody molecule capable of binding to complement component 5a receptor 1 (C5aR1), is Ab11v2, comprising a variable light chain with comprises amino acid sequence of SEQ ID NO: 62, or has at least 70, 80, 90, 95, 96, 97, 98, 99, or 100% identity with, the amino acid sequence of SEQ ID NO: 62. In some embodiments, Ab11v2 can bind C5aR1 at Site II (SEQ ID NO: 1450).

In some embodiments, the antibody molecule capable of binding to complement component 5a receptor 1 (C5aR1), is Ab583, comprising a HCDR1 comprising an amino acid sequence of SEQ ID NO: 1136, a HCDR2 comprising an amino acid sequence of SEQ ID NO: 1256, and a HCDR3 comprising an amino acid sequence of SEQ ID NO: 1376; and a LCDR1 comprising an amino acid sequence of SEQ ID NO: 1195, a LCDR2 comprising an amino acid sequence of SEQ ID NO: 1315, and a LCDR3 comprising an amino acid sequence of SEQ ID NO: 1435 or comprises a sequence that differs by no more than 5, 4, 3, 2 or 1 amino acids from amino acids of SEQ ID Nos: 1136, 1256, 1376, 1195, 1315 and/or 1435. In some embodiments, the antibody molecule capable of binding to complement component 5a receptor 1 (C5aR1), is Ab583, comprising a variable heavy chain comprises an amino acid sequence of SEQ ID NO: 1016; or has at least 70, 80, 90, 95, 96, 97, 98, 99, or 100% identity with, the amino acid sequence of SEQ ID NO: 1016. In some embodiments, the antibody molecule capable of binding to complement component 5a receptor 1 (C5aR1), is Ab583, comprising a variable light chain comprises amino acid sequence of SEQ ID NO: 1075 or has at least 70, 80, 90, 95, 96, 97, 98, 99, or 100% identity with, the amino acid sequence of SEQ ID NO: 1075. In some embodiments, Ab583 can bind C5aR1 at Site I (SEQ ID NO: 1449 or SEQ ID NO: 1452).

In some embodiments, the antibody molecule capable of binding to complement component 5a receptor 1 (C5aR1), is the antibody Ab66, comprising a HCDR1 comprising an amino acid sequence of SEQ ID NO: 1082, a HCDR2 comprising an amino acid sequence of SEQ ID NO: 1202; and a HCDR3 comprising an amino acid sequence of SEQ ID NO: 1322; and a LCDR1 comprising an amino acid sequence of SEQ ID NOs: 1143, a LCDR2 comprising an amino acid sequence of SEQ ID NOs: 1263, and a LCDR3 comprising an amino acid sequence of SEQ ID NOs: 1383; or comprises a sequence that differs by no more than 5, 4, 3, 2 or 1 amino acids from amino acids of SEQ ID Nos: 1082, 1202, 1322, 1143, 1263, and/or 1383. In some embodiments, the antibody molecule capable of binding to complement component 5a receptor 1 (C5aR1), is Ab66, comprising a variable heavy chain comprises amino acid sequence of SEQ ID NO: 962, or has at least 70, 80, 90, 95, 96, 97, 98, 99, or 100% identity with, the amino acid sequence of SEQ ID NO: 962. In some embodiments, the antibody molecule capable of binding to complement component 5a receptor 1 (C5aR1), is Ab66, comprising a variable light chain comprises amino acid sequence of SEQ ID NO: 1023, or has at least 70, 80, 90, 95, 96, 97, 98, 99, or 100% identity with, the amino acid sequence of SEQ ID NO: 1023. In some embodiments, Ab66 can bind C5aR1 at Site I (SEQ ID NO: 1449 or SEQ ID NO: 1452).

In some embodiments, the antibody molecule capable of binding to complement component 5a receptor 1 (C5aR1), is the antibody Ab322, comprising a HCDR1 comprising an amino acid sequence of SEQ ID NO: 1091, a HCDR2 comprising an amino acid sequence of SEQ ID NO: 1211; and a HCDR3 comprising an amino acid sequence of SEQ ID NO: 1331; and a LCDR1 comprising an amino acid sequence of SEQ ID NOs: 1151, a LCDR2 comprising an amino acid sequence of SEQ ID NOs: 1271, and a LCDR3 comprising an amino acid sequence of SEQ ID NOs: 1391;

or comprises a sequence that differs by no more than 5, 4, 3, 2 or 1 amino acids from amino acids of SEQ ID Nos: 1091, 1211, 1331, 1151, 1271 and/or 1391. In some embodiments, the antibody molecule capable of binding to complement component 5a receptor 1 (C5aR1), is Ab322, comprising a variable heavy chain comprises amino acid sequence of SEQ ID NO: 971, or has at least 70, 80, 90, 95, 96, 97, 98, 99, or 100% identity with, the amino acid sequence of SEQ ID NO: 971. In some embodiments, the antibody molecule capable of binding to complement component 5a receptor 1 (C5aR1), is Ab322, comprising a variable light chain comprises amino acid sequence of SEQ ID NO: 1031, or has at least 70, 80, 90, 95, 96, 97, 98, 99, or 100% identity with, the amino acid sequence of SEQ ID NO: 1031. In some embodiments, Ab322 can bind C5aR1 at Site I (SEQ ID NO: 1449 or SEQ ID NO: 1452).

In some embodiments, the antibody molecule capable of binding to complement component 5a receptor 1 (C5aR1), is the antibody Ab329, comprising a HCDR1 comprising an amino acid sequence of SEQ ID NO: 1092, an HCDR2 comprising an amino acid sequence of SEQ ID NO: 1212, and an HCDR3 comprising and amino acid sequence of SEQ ID NO: 1332, a LCDR1 comprising an amino acid sequence of SEQ ID NO: 1152, a LCDR2 comprising an amino acid sequence of SEQ ID NO: 1272, and a LCDR3 comprising an amino acid sequence of SEQ ID NO: 1392; or comprises a sequence that differs by no more than 5, 4, 3, 2 or 1 amino acids from amino acids of SEQ ID Nos: 1092, 1212, 1332, 1152, 1272 and/or 1392. In some embodiments, the antibody molecule capable of binding to complement component 5a receptor 1 (C5aR1), is Ab329, comprising a variable heavy chain comprises amino acid sequence of SEQ ID NO: 972, or has at least 70, 80, 90, 95, 96, 97, 98, 99, or 100% identity with, the amino acid sequence of SEQ ID NO: 972. In some embodiments, the antibody molecule capable of binding to complement component 5a receptor 1 (C5aR1), is Ab329, comprising a variable light chain comprises amino acid sequence of SEQ ID NO: 1032, or has at least 70, 80, 90, 95, 96, 97, 98, 99, or 100% identity with, the amino acid sequence of SEQ ID NO: 1032. In some embodiments, Ab329 can bind C5aR1 at Site II (SEQ ID NO: 1450).

In some embodiments, the antibody molecule capable of binding to complement component 5a receptor 1 (C5aR1), is the antibody Ab336v2, comprises a HCDR1 comprising an amino acid sequence of SEQ ID NOs: 1097, a HCDR2 comprising an amino acid sequence of SEQ ID NOs: 1217 and a HCDR3 comprising an amino acid sequence of SEQ ID NOs: 1337; and a LCDR1 comprising an amino acid sequence of SEQ ID NOs: 1157, a LCDR2 comprising an amino acid sequence of SEQ ID NOs: 1277, and a LCDR3 comprising an amino acid sequence of SEQ ID NOs: 1397; or comprises a sequence that differs by no more than 5, 4, 3, 2 or 1 amino acids from amino acids of SEQ ID Nos: 1097, 1217, 1337, 1157, 1277 and/or 1397. In some embodiments, the antibody molecule capable of binding to complement component 5a receptor 1 (C5aR1), is Ab336v2, comprising a variable heavy chain comprises amino acid sequence of SEQ ID NO: 977, or has at least 70, 80, 90, 95, 96, 97, 98, 99, or 100% identity with, the amino acid sequence of SEQ ID NO: 977. In some embodiments, the antibody molecule capable of binding to complement component 5a receptor 1 (C5aR1), is Ab336v2, comprising a variable light chain comprises amino acid sequence of SEQ ID NO: 1037, or has at least 70, 80, 90, 95, 96, 97, 98, 99, or 100% identity with, the amino acid sequence of SEQ ID NO: 1037. In some embodiments, Ab336v2 can bind C5aR1 at Site II) (SEQ ID NO: 1450).

In some embodiments, the antibody molecule capable of binding to complement component 5a receptor 1 (C5aR1), is the antibody Ab11v2, comprises a HCDR1 comprising an amino acid sequence of SEQ ID NOs: SEQ ID NOs: 1082, a HCDR2 comprising an amino acid sequence of SEQ ID NOs: 1202; and a HCDR3 comprising an amino acid sequence of SEQ ID NOs: 1322; and a LCDR1 comprising an amino acid sequence of SEQ ID NOs: 1142, a LCDR2 comprising an amino acid sequence of SEQ ID NOs: 1262, and a LCDR3 comprising an amino acid sequence of SEQ ID NOs: 1382 or comprises a sequence that differs by no more than 5, 4, 3, 2 or 1 amino acids of SEQ ID Nos: 1082, 1202, 1322, 1142, 1262 and/or 1382. In some embodiments, the antibody molecule capable of binding to complement component 5a receptor 1 (C5aR1), is Ab11v2, comprising a variable heavy chain with amino acid sequence of SEQ ID NO: 962, or has at least 70, 80, 90, 95, 96, 97, 98, 99, or 100% identity with, the amino acid sequence of SEQ ID NO: 962. In some embodiments, the antibody molecule capable of binding to complement component 5a receptor 1 (C5aR1), is Ab11v2, comprising a variable light chain with comprises amino acid sequence of SEQ ID NO: 1022, or has at least 70, 80, 90, 95, 96, 97, 98, 99, or 100% identity with, the amino acid sequence of SEQ ID NO: 1022. In some embodiments, Ab11v2 can bind C5aR1 at Site II (SEQ ID NO: 1450).

In an embodiment, the antibody molecule comprises one, two, or three CDRs of the VH described herein, e.g., in Table 1A, 2A, or 3A (e.g., any of VH-11, VH-11v2, VH-66, VH-79, VH-184, VH-216, VH-272, VH-308, VH-317, VH-317v2, VH-322, VH-329, VH-330, VH-332, VH-335, VH-336v1, VH-336v2, VH-336v3, VH-338, VH-341v1, VH-341v2, VH-343, VH-399, VH-402, VH-416, VH-429, VH-430, VH-440, VH-453, VH-454, VH-465, VH-475, VH-481, VH-497, VH-502, VH-503, VH-504, VH-507, VH-508, VH-510, VH-511, VH-521, VH-530, VH-536, VH-541, VH-547, VH-549, VH-550, VH-553, VH-556, VH-557, VH-567, VH-568, VH-570, VH-573, VH-583, VH-584, VH-585, VH-586, VH-588, or VH-592), using the IMGT, Kabat, or Chothia definitions of CDRs.

In an embodiment, the antibody molecule comprises one, two, or three CDRs of the VL described herein, e.g., in Table 1B, 2B, or 3B (e.g., any of VK-11, VK-66, VK-79, VK-184, VK-184CY, VK-216_272, VK-308, VK-317, VK-317v2, VK-322, VK-329, VK-330, VK-332, VK-335, VK-336v1, VK-336v2, VK-338v1, VK-338v2, VK-341v1, VK-341v2, VK-343, VK-399, VK-402, VK-416, VK-429, VK-430, VK-440, VK-453, VK-454, VK-465, VK-475, VK-481, VK-497, VK-502, VK-503, VK-504, VK-507, VK-508, VK-510, VK-511, VK-518, VK-528, VK-521, VK-530, VK-541, VK-547, VK-549, VK-550, VK-553, VK-556, VK-557, VK-567, VK-568, VK-583, VK-584, VK-585, VK-586, VK-588, VK-592), using the IMGT, Kabat, or Chothia definitions of CDRs.

In an embodiment, the antibody molecule comprises one, two, or three CDRs of the VH of an antibody molecule described herein, e.g., in Table 1A, 2A, or 3A (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592, e.g., as listed in Table 1C), using the IMGT, Kabat, or Chothia definitions of CDRs.

In an embodiment, the antibody molecule comprises one, two, or three CDRs of the VL region of an antibody molecule described herein, e.g., in Table 1B, 2B, or 3B (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C)), using the IMGT, Kabat, or Chothia definitions of CDRs.

In an embodiment, the antibody molecule is capable of binding, or substantially binding, to human C5aR1. In an embodiment, the antibody molecule binds to C5aR1 with high affinity, e.g., with a dissociation constant (KD) of less than about 100 nM, typically about 10 nM, and more typically, about 10-0.001 nM, about 10-0.01 nM, about 10-0.01 nM, about 5-0.01 nM, about 3-0.05 nM, about 1-0.1 nM, or stronger, e.g., less than about 80, 70, 60, 50, 40, 30, 20, 10, 8, 6, 4, 3, 2, 1, 0.5, 0.2, 0.1, 0.05, 0.01, 0.005, or 0.001 nM. In an embodiment, the antibody molecule binds to C5aR1 with a $K_{off}$ slower than $1\times10^{-4}$, $5\times10^{-5}$, or $1\times\times10^{5}s^{-1}$. In an embodiment, the antibody molecule binds to C5aR1 with a $K_{on}$ faster than $1\times10^4$, $5\times10^4$, $1\times10^5$, or $5\times10^5$ $M^{-1}$ $s^{-1}$.

In an embodiment, the antibody molecule is capable of binding, or substantially binding, to human C5aR1. In an embodiment, the antibody molecule binds to C5aR1 with high affinity, e.g., with a dissociation constant ($K_D$) of less than about 100 nM, typically about 10 nM, and more typically, about 10-0.001 nM, about 10-0.01 nM, about 10-0.01 nM, about 5-0.01 nM, about 3-0.05 nM, about 1-0.1 nM, or stronger, e.g., less than about 80, 70, 60, 50, 40, 30, 20, 10, 8, 6, 4, 3, 2, 1, 0.5, 0.2, 0.1, 0.05, 0.01, 0.005, or 0.001 nM. In an embodiment, the antibody molecule binds to C5aR1 with a $K_{off}$ slower than $1\times10^{-4}$, $5\times10$, or $1\times10^{-5}$ $s^{-1}$. In an embodiment, the antibody molecule binds to C5aR1 with a $K_{on}$ faster than $1\times10^4$, $5\times10^4$, $1\times10^5$, or $5\times10^5$ $M^{-1}s^{-1}$.

In an embodiment, the antibody molecule inhibits binding of human C5aR1 to human C5a by 50% or more, e.g., 60% or more, 70% or more, 80% or more, 85% or more, 90% or more, 95% or more, 96% or more, 97% or more, 98% or more, 99% or more, or 100%, as determined by a method described herein (e.g., normalized to the no antibody control).

An antibody can be humanized by any suitable method, and several such methods known in the art (see e.g., Morrison, S. L., 1985, *Science* 229:1202-1207, by Oi et al., 1986, *BioTechniques* 4:214, and by Queen et al. U.S. Pat. Nos. 5,585,089, 5,693,761 and 5,693,762, the contents of all of which are hereby incorporated by reference).

Humanized or CDR-grafted antibodies can be produced by CDR-grafting or CDR substitution, wherein one, two, or all CDRs of an immunoglobulin chain can be replaced. See e.g., U.S. Pat. No. 5,225,539; Jones et al. 1986 *Nature* 321:552-525; Verhoeyan et al. 1988 *Science* 239:1534; Beidler et al. 1988 *J. Immunol.* 141:4053-4060; Winter U.S. Pat. No. 5,225,539, the contents of all of which are hereby expressly incorporated by reference. Winter describes a CDR-grafting method which may be used to prepare humanized antibodies (UK Patent Application GB 2188638A, filed on Mar. 26, 1987; Winter U.S. Pat. No. 5,225,539), the contents of which is expressly incorporated by reference.

Also provided are humanized antibodies in which specific amino acids have been substituted, deleted or added. Criteria for selecting amino acids from the donor are described in, e.g., U.S. Pat. No. 5,585,089, e.g., columns 12-16 of U.S. Pat. No. 5,585,089, the contents of which are hereby incorporated by reference. Other techniques for humanizing antibodies are described in Padlan et al. EP 519596 A1, published on Dec. 23, 1992.

In an embodiment, the antibody molecule has a heavy chain constant region chosen from, e.g., the heavy chain constant regions of IgG1, IgG2 (e.g., IgG2a), IgG3, IgG4, IgM, IgA1, IgA2, IgD, and IgE; particularly, chosen from, e.g., the (e.g., human) heavy chain constant regions of IgG1, IgG2, IgG3, and IgG4. In another embodiment, the antibody molecule has a light chain constant region chosen from, e.g., the (e.g., human) light chain constant regions of kappa or lambda. The constant region can be altered, e.g., mutated, to modify the properties of the antibody molecule (e.g., to increase or decrease one or more of: Fc receptor binding, antibody glycosylation, the number of cysteine residues, effector cell function, and/or complement function). In an embodiment, the antibody molecule has effector function and can fix complement. In another embodiment, the antibody molecule does not recruit effector cells or fix complement. In certain embodiments, the antibody molecule has reduced or no ability to bind an Fc receptor. For example, it may be an isotype or subtype, fragment or other mutant, which does not support binding to an Fc receptor, e.g., it has a mutagenized or deleted Fc receptor binding region.

In an embodiment, a constant region of the antibody molecule is altered. Methods for altering an antibody constant region are known in the art. Antibody molecules s with altered function, e.g. altered affinity for an effector ligand, such as FcR on a cell, or the C1 component of complement can be produced by replacing at least one amino acid residue in the constant portion of the antibody with a different residue (see e.g., EP 388,151 A1, U.S. Pat. Nos. 5,624,821 and 5,648,260, the contents of all of which are hereby incorporated by reference) Amino acid mutations which stabilize antibody structure, such as S228P (EU nomenclature, S241P in Kabat nomenclature) in human IgG4 are also contemplated. Similar type of alterations could be described which if applied to the murine, or other species immunoglobulin would reduce or eliminate these functions.

In an embodiment, the only amino acids in the antibody molecule are canonical amino acids. In an embodiment, the antibody molecule comprises naturally-occurring amino acids; analogs, derivatives and congeners thereof; amino acid analogs having variant side chains; and/or all stereoisomers of any of any of the foregoing. The antibody molecule may comprise the D- or L-optical isomers of amino acids and peptidomimetics.

A polypeptide of an antibody molecule described herein may be linear or branched, it may comprise modified amino acids, and it may be interrupted by non-amino acids. The antibody molecule may also be modified; for example, by disulfide bond formation, glycosylation, lipidation, acetylation, phosphorylation, or any other manipulation, such as conjugation with a labeling component. The polypeptide can be isolated from natural sources, can be a produced by recombinant techniques from a eukaryotic or prokaryotic host, or can be a product of synthetic procedures.

The antibody molecule described herein can be used alone in unconjugated form, or can be bound to a substance, e.g., a toxin or moiety (e.g., a therapeutic drug; a compound emitting radiation; molecules of plant, fungal, or bacterial origin; or a biological protein (e.g., a protein toxin) or particle (e.g., a recombinant viral particle, e.g., via a viral coat protein). For example, the anti-C5aR1 antibody can be coupled to a radioactive isotope such as an α-, β-, or γ-emitter, or a β- and γ-emitter.

An antibody molecule can be derivatized or linked to another functional molecule (e.g., another peptide or protein). As used herein, a "derivatized" antibody molecule is one that has been modified. Methods of derivatization include but are not limited to the addition of a fluorescent moiety, a radionucleotide, a toxin, an enzyme or an affinity ligand such as biotin. Accordingly, the antibody molecules are intended to include derivatized and otherwise modified forms of the antibodies described herein, including immunoadhesion molecules. For example, an antibody molecule can be functionally linked (by chemical coupling, genetic fusion, noncovalent association or otherwise) to one or more other molecular entities, such as another antibody (e.g., a bispecific antibody or a diabody), a detectable agent, a toxin, a pharmaceutical agent, and/or a protein or peptide that can mediate association of the antibody or antibody portion with another molecule (such as a streptavidin core region or a polyhistidine tag).

Some types of derivatized antibody molecule are produced by crosslinking two or more antibodies (of the same type or of different types, e.g., to create bispecific antibodies). Suitable crosslinkers include those that are heterobifunctional, having two distinctly reactive groups separated by an appropriate spacer (e.g., m-maleimidobenzoyl-N-hydroxysuccinimide ester) or homobifunctional (e.g., disuccinimidyl suberate). Such linkers are available from Pierce Chemical Company, Rockford, Ill.

Useful detectable agents with which an anti-dengue antibody molecule may be derivatized (or labeled) to include fluorescent compounds, various enzymes, prosthetic groups, luminescent materials, bioluminescent materials, fluorescent emitting metal atoms, e.g., europium (Eu), and other anthanides, and radioactive materials (described below). Exemplary fluorescent detectable agents include fluorescein, fluorescein isothiocyanate, rhodamine, 5dimethylamine-1-napthalenesulfonyl chloride, phycoerythrin and the like. An antibody may also be derivatized with detectable enzymes, such as alkaline phosphatase, horseradish peroxidase, β-galactosidase, acetylcholinesterase, glucose oxidase and the like. When an antibody is derivatized with a detectable enzyme, it is detected by adding additional reagents that the enzyme uses to produce a detectable reaction product. For example, when the detectable agent horseradish peroxidase is present, the addition of hydrogen peroxide and diaminobenzidine leads to a colored reaction product, which is detectable. An antibody molecule may also be derivatized with a prosthetic group (e.g., streptavidin/biotin and avidin/biotin). For example, an antibody may be derivatized with biotin, and detected through indirect measurement of avidin or streptavidin binding. Examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; and examples of bioluminescent materials include luciferase, luciferin, and aequorin.

Labeled antibody molecules can be used, for example, diagnostically and/or experimentally in a number of contexts, including (i) to isolate a predetermined antigen by standard techniques, such as affinity chromatography or immunoprecipitation; (ii) to detect a predetermined antigen (e.g., in a cellular lysate or cell supernatant) in order to evaluate the abundance and pattern of expression of the protein; (iii) to monitor protein levels in tissue as part of a clinical testing procedure, e.g., to determine the efficacy of a given treatment regimen.

An antibody molecule may be conjugated to another molecular entity, typically a label or a therapeutic (e.g., antimicrobial (e.g., antibacterial or bactericidal), immunomodulatory, immunostimularoty, cytotoxic, or cytostatic) agent or moiety. Radioactive isotopes can be used in diagnostic or therapeutic applications. Radioactive isotopes that can be coupled to the antibody molecules include, but are not limited to α-, β-, or γ-emitters, or β- and γ-emitters. Such radioactive isotopes include, but are not limited to iodine ($^{121}$I or $^{125}$I), yttrium ($^{90}$Y), lutetium ($^{177}$Lu), actinium (225Ac), praseodymium, astatine ($^{211}$At), rhenium ($^{186}$Re), bismuth ($^{212}$Bi or $^{213}$Bi), indium ($^{111}$In), technetium ($^{99}$mTc), phosphorus ($^{32}$P), rhodium ($^{188}$Rh), sulfur ($^{35}$S), carbon ($^{14}$C), tritium ($^{3}$H), chromium ($^{51}$Cr), chlorine ($^{36}$Cl), cobalt ($^{57}$Co or $^{58}$Co), iron ($^{59}$Fe), selenium ($^{75}$ e), or gallium ($^{67}$Ga). Radioisotopes useful as therapeutic agents include yttrium ($^{90}$Y), lutetium ($^{177}$Lu), actinium ($^{225}$Ac), praseodymium, astatine ($^{211}$At), rhenium ($^{186}$Re), bismuth ($^{212}$Bi or $^{213}$Bi), and rhodium ($^{188}$Rh). Radioisotopes useful as labels, e.g., for use in diagnostics, include iodine ($^{121}$I or $^{125}$I), indium ($^{111}$In), technetium ($^{99}$mTc), phosphorus ($^{32}$P), carbon ($^{14}$C), and tritium ($^{3}$H), or one or more of the therapeutic isotopes listed above.

The present disclosure provides radiolabeled antibody molecules and methods of labeling the same. In an embodiment, a method of labeling an antibody molecule is disclosed. The method includes contacting an antibody molecule, with a chelating agent, to thereby produce a conjugated antibody. The conjugated antibody is radiolabeled with a radioisotope, e.g., $^{111}$Indium, $^{90}$Yttrium and $^{177}$Lutetium, to thereby produce a labeled antibody molecule.

In another aspect, this disclosure provides a method of making an antibody molecule disclosed herein. The method includes, for example, providing an antigen, e.g., C5aR1 or a fragment thereof; obtaining an antibody molecule that specifically binds to the antigen; evaluating efficacy of the antibody molecule in modulating activity of the antigen and/or organism expressing the antigen, e.g., C5aR1. The method can further include administering the antibody molecule, including a derivative thereof (e.g., a humanized antibody molecule) to a subject, e.g., a human.

This disclosure provides an isolated nucleic acid molecule encoding the above antibody molecule, vectors and host cells thereof. The nucleic acid molecule includes, but is not limited to, RNA, genomic DNA and cDNA.

Amino acid sequences of exemplary antibody molecules are described in Tables 1A, 1B, 2A, 2B, 3A, and 3B. Tables 1A, 2A, and 3A list exemplary heavy chain variable region sequences and complementarity-determining regions (CDRs) thereof. Tables 1B, 2B, and 3B list exemplary light chain variable region sequences and complementarity-determining regions (CDRs) thereof. Table 1C lists matched pairs of heavy and light chain variable regions from exemplary antibody molecules described herein.

TABLE 1A

The amino acid sequences of the heavy chain variable region (VH) and IMGT HCDRs of the exemplary anti-O5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-11 | QVQLQQSGPELVKPGASVK ISCKASGYSFSSSWMNWVK QRPGKGLEWIGRISPGDGD | 1 | GYSFSSSW | 121 | ISPGDGD | 241 | VRRFLITSTRYVMDYWG | 361 |

TABLE 1A-continued

The amino acid sequences of the heavy chain variable
region (VH) and IMGT HCDRs of the exemplary anti-O5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| | TRYSGKFKGKATLTADKSS STAYMQVTSLTSEDSAIYF CVRRFLITSTRYVMDYWGQ GTTVTVSS | | | | | | | |
| VH-11v2 | QVQLQQSGPELVKPGASVK ISCKASGYSFSSSWMNWVK QRPGKGLEWIGRISPGDGD TRYSGKFKGKATLTADKSS STAYMQVTSLTSEDSAIYF CVRFLITSTRYVMDYWGQG TTVTVSS | 2 | GYSFSSSW | 122 | ISPGDGD | 242 | VRFLITSTRYVMDYWG | 362 |
| VH-66 | QVQLQQSDAELVKPGASVK ISCKASGYTFIDHAIHWVK QRPEQGLEWIGYISPGNGE IKYNEKFKAKATLTADKSS SAAYMQLNSLTSADSAVYF CKRALFYYTGKYQPMDYWG QGTTVTDSS | 3 | GYTFIDHA | 123 | ISPGNGE | 243 | KRALFYYTGKYQPMDYWG | 363 |
| VH-79 | QVQLKESGPGLVAPSQSLS ITCTVSGFSLTSYAISWVR QPPGKGLEWLGVIWTGGGT KYNSALKSRLSISKDNSKS HVFLKMNSLQSDDTARYYC ARDGDYVYYAMAYWGQGTT VTVSS | 4 | GFSLTSYA | 124 | IWTGGG | 244 | ARDGDYVYYAMAYWG | 364 |
| VH-184 | QVQLQQSGAELVKPGASVK ISCKASGYAFSRYWMNWVK QRPGKGLEWIGQIYPGDGD TKYNGKFKGKATLTADKSS STAYMQLNSLTSEDSAVYF CTRSLGVWGTGTTVTVSS | 5 | GYAFSRYW | 125 | IYPGDGD | 245 | TRSLGVWG | 365 |
| VH-216 | QIQLVQSGPELKKPGETVK ISCKASGYSFTTFGMSWVK QAPGKVLKWMGWINTYSGV PTYADDFKGRFAFSLETSA STAYLQINNLKNEDTATYF CARGLGRLLAYWGQGTLVT VSA | 6 | GYSFTTFG | 126 | INTYSGV | 246 | ARGLGRLLAYWG | 366 |
| VH-272 | QVQLQQSGAELVKPGASVK ISCKASGYAFSSYWMNWVK QRPGKGLEWIGHIYPGDGD TKYNGKFKGKATLTADKSS STAYMQVSSLTSEDSAVYF CTRSLGVWGTGTTVTVSS | 7 | GYAFSSYW | 127 | IYPGDGD | 247 | TRSLGVWG | 367 |
| VH-308 | QVQLQQSGAELAKPGASVK MSCKASGYTFTSYWMHWVK QRPGQGLEWIGYINPSSGY TEYNQKFKDKATLTADKSS STAYMQLSSLTSEDSAVYY CARGMFAMDYWGQGTTVTV SS | 8 | GYTFTSYW | 128 | INPSSGY | 248 | ARGMFAMDYWG | 368 |
| VH-317 | QVQLQQPGAELVMPGASVK LSCKASGYTFTSYWLHWVR QRPGQGLEWIGEIDPSDGY SNHNQKFKGKATLTVDKSS STAYMQLSSLTSEDSAVYY CATEGFWGQGTTVTVSS | 9 | GYTFTSYW | 129 | IDPSDGY | 249 | ATEGFWG | 369 |
| VH-317v2 | QVQLQQPGAELVMPGASVK LSCKASGYTFTSYWMHWVK QRPGQGLEWIGEIDPSDSY TNYNQKFKGKATLTVDKSS STAYMQLSSLTSEDSAVYY CARVAYYSNFGGFAYWGQG TTVTVSS | 10 | GYTFTSYW | 130 | IDPSDSY | 250 | ARVAYYSNFGGFAYWG | 370 |

TABLE 1A-continued

The amino acid sequences of the heavy chain variable region (VH) and IMGT HCDRs of the exemplary anti-O5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-322 | QVQLQQSDAALVKPGASVKISCKASGHTFTDHAIHWVKQRPEQGLEWIGYISPGNGDIKYNDKFKGKATLTADKSSSTAYMQLNSLTPEDSAVYFCKGPLFVRGQYYITMDYWGQGTTVTSS | 11 | GHTFTDHA | 131 | ISPGNGD | 251 | KGPLFVRGQYYITMDYWG | 371 |
| VH-329 | QVQLQQSGAELTKPGASVKLSCKASGYTFTNYWMHWVKQRPGQGLEWIGYLNPSSGYTKYNQKFKDKATLTADKSSSTAYMQLNSLTYEDSAVYYCTRSGGDNYGNPYYFDRWGQGTTVTSS | 12 | GYTFTNYW | 132 | LNPSSGY | 252 | TRSGGDNYGNPYYFDRWG | 372 |
| VH-330 | QVQLKQSGPGLVQPSQSLSIACTVSGFSLTSYGVHWVRQSPGKGLEWLGVIWRGGSTDYNAAFKSRLSITKDNSKSQVFFTMNRLHADDTAIYYCAKNSQLGNAMDYWGQGTTVTVSS | 13 | GFSLTSYG | 133 | IWRGGS | 253 | AKNSQLGNAMDYWG | 373 |
| VH-332 | QVQLQQSDAELVKPGASVKISCKASGYTFTDHSIHWVKQRPEQGLEWIGYISPGNGDIKYDEKFKGKATLTADTSSSTAYMQLNSLTSEDSAVYFCKGPLLLRWRYFYPVDYWGQGTTVTSS | 14 | GYTFTDHS | 134 | ISPGNGD | 254 | KGPLLLRWRYFYPVDYWG | 374 |
| VH-335 | QVQLQQSDAALVKPGASVKISCKASGYTFTDHAIHWVKQRPEQGLEWIGYISPGNGDIKYNEKFKGKATLTADKSSSTAYMQLNSLTSEDSAVYFCKGPLLVRWRYYITMDYWGQGTTVTSS | 15 | GYTFTDHA | 135 | ISPGNGD | 255 | KGPLLVRWRYYITMDYWG | 375 |
| VH-336v1 | EVKLEESGGGLVQPGGSMKLSCAASGFTFSDAWMDWVRQSPEKGLEWVAEIRNKANNHATYYAESVKGRFTISRDDSKSSVYLQMNSLRAEDTGIYYCTRGGYYVFAYWGQGTTVTVSS | 16 | GFTFSDAW | 136 | IRNKANNHA | 256 | TRGGYYVFAYWG | 376 |
| VH-336v2 | QVQLKQSGPGLVQSSQSLSITCTVSGFSLISYGVHWVRQSPGKGLEWLGVIWSGGSTDYNAAFKSRLSITKDNSKSQVFFKMNSLQADDTAIYYCAKNSQLGNAMDYWGQGTTVTVSS | 17 | GFSLISYG | 137 | IWSGGS | 257 | AKNSQLGNAMDYWG | 377 |
| VH-336v3 | QVQLQQPGAELVKPGASVKLSCKASGYTFTSYWMHWVKQRPGQGLEWIGMIHPNSNSTNYNEKFKSKATLTVDKSSSTAYMQLSSLTSEDSAVYYCARSLTGTKTYWGQGTTVTVSS | 18 | GYTFTSYW | 138 | IHPNSNS | 258 | ARSLTGTKTYWG | 378 |
| VH-338 | EVQLQQSGPELVKPGASVKMSCKASGYTFTDYNMHWVKQSHGKSLEWIGYINPNNGGTSYNQKFKGKATLTVNKSSSTAYMELRSLTSEDSAVYCAHGEGDYAYWGQGTTVTVSS | 19 | GYTFTDYN | 139 | INPNNGG | 259 | AHGEGDYAYWG | 379 |

TABLE 1A-continued

The amino acid sequences of the heavy chain variable
region (VH) and IMGT HCDRs of the exemplary anti-O5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-341v1 | EFQLQQSGPELVKPGASVKMSCKASGYTFTKYVIHWVKQKPGQGLEWIGYINPYNDGTKYNEKFKGKARLTSDKSSNTVYMDLSSLTSEDSAVYYCATARATSYWGQTTVTVSS | 20 | GYTFTKYV | 140 | INPYNDG | 260 | ATARATSYWG | 380 |
| VH-341v2 | QVQLQQPGAEFVKPGASVKMSCKASGYSFTSYWITWLKQRPGQGLEWIGDIYPGRGTTDYNEKLKSRATLTVDTSSTTAYMQLSSLTSEDSAVYYCARWGTTGRSYWGQGTTVTVSS | 21 | GYSFTSYW | 141 | IYPGRGT | 261 | ARWGTTGRSYWG | 381 |
| VH-343 | QVQLQQSGAELVKPGASVKLSCKASGYTFTEYTIHWVNQRSGQGLEWIGWFYPGSGSIKYNEKFKDKATLTADKSSHTVYMELSRLTSEDSAVYFCARHGNYYDGSWFAYWGQGTLVTVSA | 22 | GYTFTEYT | 142 | FYPGSGS | 262 | ARHGNYYDGSWFAYWG | 382 |
| VH-399 | EVQLVESGGDLVKPGGSLKLSCAASGFTFSNYGMSWVRQTPDKRLEWVATITSGGTHTYYPDSVKGRFTISRDNAKNTLYLQMSSLKSEDTAMYYCTRHGAYYSNPWFAYWGQGTLVTVS | 23 | GFTFSNYG | 143 | ITSGGTH | 263 | TRHGAYYSNPWFAYWG | 383 |
| VH-402 | QIQLVQSGPELKKPGETVKISCKASGYTFTTFGMSWVKQAPGKGLKWMGWINTNSGMPTYTDDFRGRFAFSLETSASTAYLQISSLKNEDTATYFCARKSLFYWGQGTTLTVSS | 24 | GYTFTTFG | 144 | INTNSGM | 264 | ARKSLFYWG | 384 |
| VH-416 | QVQLQQSGAELAKPGASVKLSCKASGYTFISYWMHWVKQRPGQGLEWIGYINPRSDYAKYNQKFKDKATLTTNKSSSTAYMQLSSLTYEDYAVYYCARVTGTEGPYYFDYWGQGTTLTVSS | 25 | GYTFISYW | 145 | INPRSDY | 265 | ARVTGTEGPYYFDYWG | 385 |
| VH-429 | QVQLQQSGAELAKPGASVKLSCKASGYTFSSYWIHWVKQRPGQGLEWIGYINPRGDYTKYNQKFKDKATLTADKSSSTAFMQLSSLTYEDSAVYYCVRVTGSEGPYYFDYWGQGTTLTVSS | 26 | GYTFSSYW | 146 | INPRGDY | 266 | VRVTGSEGPYYFDYWG | 386 |
| VH-430 | QVQLQQSGADLAKPGASVKLSCKASGYTFTSYWIHWVKQRPGQGLEWIGYINPRGDYTKYNQKFKDKATLTADRSSSTAYMQLSSLTYEDYAVYYCARVTGTEGPYYFDYWGQGTTLTVSS | 27 | GYTFTSYW | 147 | INPRGDY | 267 | ARVTGTEGPYYFDYWG | 387 |
| VH-440 | QIQLVQSGPELKKPGETVKISCKASGYTFTAYGMSWVKQTPGKGLKWMGWINTYSGVPANADDFKGRFAFSLETSASTAYLQINNLKNEDTATYFCARSRYDGYFDYWGQGTTLTVSS | 28 | GYTFTAYG | 148 | INTYSGV | 268 | ARSRYDGYFDYWG | 388 |

TABLE 1A-continued

The amino acid sequences of the heavy chain variable region (VH) and IMGT HCDRs of the exemplary anti-O5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-453 | QVQLKQSGPGQVAPSQSLSITCTVSGFSLINSAVHWVRQSPGKGLEWLGVIWSDGSTDYNTAFISRLSISRDNSKSQVFFKMRSLQVDDTAVYYCARNGRLGNAMDYWGQGTSVTVSS | 29 | GFSLINSA | 149 | IWSDGS | 269 | ARNGRLGNAMDYWG | 389 |
| VH-454 | QVQLKQSGPGLVAPSQSLSITCTVSGFSLTSYGVDWIRQSPGKGLEWLGVIWGVGSTNYNSALKSRLSISKDNSRSQVFLKLNSLQTDDTAMYYCASPYYSHYVPFAYWGQGTLVTVSA | 30 | GFSLTSYG | 150 | IWGVGS | 270 | ASPYYSHYVPFAYWG | 390 |
| VH-465 | QVQLQQSGAELAKPGASVKLSCKASGYIFTSYWMNWVKQRPGQGLEWIGYINPSTTSTKYNQKFKDKATLTADKSSTTAYMQLTSLTYEDSAVYYCARPDNSGYVGFAYWGQGTLVTVSA | 31 | GYIFTSYW | 151 | INPSTTS | 271 | ARPDNSGYVGFAYWG | 391 |
| VH-475 | QVQLKQSGPGLVAPSQSLSITCTVSGFSLTSYGVDWIRQSPGKGLEWLGVIWGVGGTNYNSALKSRLSISKDNSRSQVFLKLNSLQTDDTAMYYCASPYYSHYVPFAYWGQGTLVTVSA | 32 | GFSLTSYG | 152 | IWGVGG | 272 | ASPYYSHYVPFAYWG | 392 |
| VH-481 | QVQLQQSGAELAKPGASVQVSCKASGYSFTRYWMHWIKQRPGQGLEWIGYINPSTDYSAYNQKFKDKATLTADKSSSTAYLQLTSLTSEDSAVYYCAGGLPHFDYWGQGTTLTVSS | 33 | GYSFTRYW | 153 | INPSTDY | 273 | AGGLPHFDYWG | 393 |
| VH-497 | QVQLKQSGPGLVAPSQSLSITCTVSGFSLTTYGVHWVRQPPGKGLEWLVVIWSDGSTTYNSALKSRLSISKDNSKSQVFLKMNSLQPDDTAMYYCARNSRYGNSFAYWGQGTLVTVSA | 34 | GFSLTTYG | 154 | IWSDGS | 274 | ARNSRYGNSFAYWG | 394 |
| VH-502 | DVQLQESGPDLVKPSQSLSLTCTVTGYSITSGYSWHWIRQFPGNKLEWMGYIHYSGSTNYNPSLKSRISITRDTSKNQFFLQLKSVTTEDTATYYCVFWLPFDYWGQGTTLTVSS | 35 | GYSITSGYS | 155 | IHYSGS | 275 | VFWLPFDYWG | 395 |
| VH-503 | DVQLQESGPGLVKPFQSLSLTCTVTGYSITSDYAWNWIRQFPGNKLEWMGYINYSGSTSYNPSLRSRISITRDTSKNQFFLHLNSVTTEDTATYYCARMGYRYPWFAYWGQGTLVTVSA | 36 | GYSITSDYA | 156 | INYSGS | 276 | ARMGYRYPWFAYWG | 396 |
| VH-504 | EVQLKQSGGGLVKPGGSLKLSCAASGFTFSSYTMSWVRQTPEKRLEWVATISSGGSYTYYPDSVKGRFTISRDNAKNTLYLQMSSLKSEDTAMYYCTRGGGNYDAMDYWGQGTSVTVSS | 37 | GFTFSSYT | 157 | ISSGGSY | 277 | TRGGGNYDAMDYWG | 397 |

TABLE 1A-continued

The amino acid sequences of the heavy chain variable region (VH) and IMGT HCDRs of the exemplary anti-O5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-507 | QVQLQQSGAELAKPGASVKLSCKASGYTFTNYWMHWVKQRPGQGLEWIGYINPSSASSKYNQKFKDRATLTTDKSSSTAFMHLSSLTYEDSAVYYCARVPLPYGSSYGPYFFDFWGQGTTLTVSS | 38 | GYTFTNYW | 158 | INPSSAS | 278 | ARVPLPYGSSYGPYFFDFWG | 398 |
| VH-508 | QVQLQQSGAELARPGASVKMSCKASGYTFTSYTMHWVKQRPGQGLEWIGYINPSSGYTKYNQKFKDKATLTADKSSSTAYMQLSSLTSEDSAVYYCARSGDYDGFAYWGQGTLVTVSA | 39 | GYTFTSYT | 159 | INPSSGY | 279 | ARSGDYDGFAYWG | 399 |
| VH-510 | QVQLQQSGAELAKPGASVKLSCKASGYTFTSYWMHWVKQRPGQGLEWIGYINPSSGYTKYNQKFKDRATLTADKSSSTAYMQLSSLTYEDSAVYYCARVPLSYGSSYGPYFFDYWGQGTTLTVSS | 40 | GYTFTSYW | 160 | INPSSGY | 280 | ARVPLSYGSSYGPYFFDYWG | 400 |
| VH-511 | QVQLQQSGAELAKPGASVKLSCKTSGYTFTNYWMHWIKQRPGLGLEWIGYINPSGDYTKHNQKFKDKATLTADRSSSTAYMQLSSLTYEDSAVYYCARVPLSYGSGNGPYYFDYWGQGTTLTVSS | 41 | GYTFTNYW | 161 | INPSGDY | 281 | ARVPLSYGSGNGPYYFDYWG | 401 |
| VH-521 | QVQLQQSRAALAKPGASVKLSCKASGYTFTNHWMHWVKQRPGQGLEWIGYINPINGFNRYNQNFKDRATLTTDKASSTAFIHLNGLTYEDFAVYYCARVPLSYGGSYGPYFFDFWGQGTILTVSS | 42 | GYTFTNHW | 162 | INPINGF | 282 | ARVPLSYGGSYGPYFFDFWG | 402 |
| VH-530 | QVQLQQSRAALAKPGASVKLSCKASGYTFTNHWLHWVKQRPGQGLEWIGYINPINGFSKYNQNFKNRATLTTDSSSSTAFIHLSGLTYEDFAVYYCARVPLSYGGSYGPYFFDFWGQGTILTVSS | 43 | GYTFTNHW | 163 | INPINGF | 283 | ARVPLSYGGSYGPYFFDFWG | 403 |
| VH-536 | QVQLQQSGAALAKPGASVKLSCKASGYSFTNYWMHWVKQRPGQGLEWIGYINPINGYGKYNQNFKDRATLTTDKSSSTAFIHLSGLTYEDSAVYYCARVPLSYGGSYGPYFFDFWGQGTILTVSS | 44 | GYSFTNYW | 164 | INPINGY | 284 | ARVPLSYGGSYGPYFFDFWG | 404 |
| VH-541 | QVQLQQSGPELVKPGESVKMSCKASGYTFTDYYMDWVKQSHGKSLEWIGYFYPNNGGVKYSQKFKDKAALTVDKSSTTAYMELHSLTFEDSAVYYCTRGSPFAYWGQGTLVTVSA | 45 | GYTFTDYY | 165 | FYPNNGG | 285 | TRGSGPFAYWG | 405 |
| VH-547 | QVQLKQSGPGLVAPSQSLSITCTVSGFSLTNYGVDWVRQSPGKGLEWLGVIWGDGITKYNSALKSRLSISKDNSKSQVFLKMNSLQTDDTAMYYCASALDYSNYGFAYWGQGTLVTVSA | 46 | GFSLTNYG | 166 | IWGDGI | 286 | ASALDYSNYGFAYWG | 406 |

TABLE 1A-continued

The amino acid sequences of the heavy chain variable region (VH) and IMGT HCDRs of the exemplary anti-O5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-549 | QVQLQQSGPELVKPGDSVKMSCKVSGYTFTDYYIDWVKQSHGKSLEWIGYFYPNNGGAKYNQKFKSKAALTVDKSSTTAYMELHSLTFEDSAVYYCTRGSGPFAYWGQGTLVTVSA | 47 | GYTFTDYY | 167 | FYPNNGG | 287 | TRGSGPFAYWG | 407 |
| VH-550 | QVQLKQSGPGLVAPSQSLSITCTVSGFSLTNCGVDWVRQSPGKSLEWLGVIWGDGLTKYNSALKSRLSISKDNSKSQVFLKVNSLQTDDTAVYYCASALDYSNYGFAYWGQGTLVTVSA | 48 | GFSLTNCG | 168 | IWGDGL | 288 | ASALDYSNYGFAYWG | 408 |
| VH-553 | QVQLQQSGPELVKPGDSVKMSCKASGYTFTDYYMDWVKQSHGKSLEWIGYFYPNNGGAKYNQKFKGKAALTVDKSSTTAYMELHSLTFEDSAVYYCTRGSGPFAYWGQGTLVTVSA | 49 | GYTFTDYY | 169 | FYPNNGG | 289 | TRGSGPFAYWG | 409 |
| VH-556 | QVQLKQSGPGLVAPSQSLSITCTVSGFSLTNCGVDWVRQSPGKSLEWLGVIWGDGLTKYNSALKSRLSISKDNSKSQVFLKVNRLQTDDTAMYYCASALDYSNFGFAYWGQGTLVTVSA | 50 | GFSLTNCG | 170 | IWGDGL | 290 | ASALDYSNFGFAYWG | 410 |
| VH-557 | QVQLQQSGPELVKPGDSVKMSCKASGYTFSDYYMDWVKQSHGKSLEWIGYFYPNNDGIRYNQRFKGRASLTVDKSSNTAYMELHSLTSEDSAVYYCARGSGPFVYWGQGTLVTVSA | 51 | GYTFSDYY | 171 | FYPNNDG | 291 | ARGSGPFVYWG | 411 |
| VH-567 | DVQLQESGPGLVKPSQSLSLTCTVTGYSITSDSAWNWIRQFPGNKLEWMGYISYSGRISYNPSLKSRISITRDTSKNQFFLQFNSVTTEDTAKYYCARASIGFDYWGQGTTLTVSS | 52 | GYSITSDSA | 172 | ISYSGR | 292 | ARASIGFDYWG | 412 |
| VH-568 | EVQLQQSGADLVKPGASVKLSCTVSGFNIKDSYIHWLKQRPGQGLEWIGRIDPTNVNTKYDPKFQGKASITTDTSSNTAYLQLSSLTSENTAVYYCARRLRQTYAMDYWGQGTSVTVSS | 53 | GFNIKDSY | 173 | IDPTNVN | 293 | ARRLRQTYAMDYWG | 413 |
| VH-570 | DVQLQESGPGLVKPSQSLSLTCTVTGYSITSDSAWNWIRQFPGNKLEWMGYISYSGRISYNPSLKSRISITRDTSKNQIFLQFNSVTTEDTAKYYCARASIGFDYWGQGTTLTVSS | 54 | GYSITSDSA | 174 | ISYSGR | 294 | ARASIGFDYWG | 414 |
| VH-573 | DVQLQESGPGLVKPSQSLSLTCTVTGYSITSDSAWNWIRQFPGNKLEWMGYISYSGRISYNPSLKSRISITRDTSKNQFFLQFYSVTTEDTARYYCARASIGFDYWGQGTTLTVSS | 55 | GYSITSDSA | 175 | ISYSGR | 295 | ARASIGFDYWG | 415 |

TABLE 1A-continued

The amino acid sequences of the heavy chain variable
region (VH) and IMGT HCDRs of the exemplary anti-05aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-583 | EVQLVESGGGLVKPGGSLK LSCAASGFTFNAYAMSWVR QTPEKRLEWVASISTGGNT YCPDSVKDRFTVSRDNVRN ILYLQMSSLRSEDTAMYYC TRGYQRFSGFAYWGQGTLV TVS | 56 | GFTFNAYA | 176 | ISTGGN | 296 | TRGYQRFSGFAYWG | 416 |
| VH-584 | DVQLQESGPDLVKPSQSLS LTCTVTGYSITSGYSWHWI RQSPGNKLEWLAYIHNSGS TNYNPSLKSRISITRDTSK NQFFLKLNSVTTEDTATYY CARSIGDYWGQGTTLAVSS | 57 | GYSITSGYS | 177 | IHNSGS | 297 | ARSIGDYWG | 417 |
| VH-585 | DVQLQESGPGLVKPSQSLS LTCTVTGYSITSDYAWNWI RQFPGNKLEWMGYISYSGS TSYNPSLKSRISITRDTSK NQFFLQLSSVTTEDTATYY CARYGGNYPTYAMDYWGQG TSVTVSS | 58 | GYSITSDYA | 178 | ISYSGS | 298 | ARYGGNYPTYAMDYWG | 418 |
| VH-586 | DVQLQESGPDLVKPSQSLS LTCIVAGFSLTDSYSWHWI RQFPGNKLEWMGYIHYSGR TNYNPSLKTQFSITRNTSK NQFFLQLISVPTEDTATYY CARYDFAYWGRGTSVTVSS | 59 | GFSLTDSYS | 179 | IHYSGR | 299 | ARYDFAYWG | 419 |
| VH-588 | DVQLQESGPGLVKPSQSLS LTCTVTGYSITSDYAWNWI RQFPGNKLEWMGYISYSGS IRYNPSLKSRISITRDTSK NQFFLQLNSVTTEDTATYY CAITTGGYFDYWGQGTTLT VSS | 60 | GYSITSDYA | 180 | ISYSGS | 300 | AITTGGYFDYWG | 420 |
| VH-592 | QVQLKQSGAELVRPGSSVG ISCKASGYAFTNFWMNWVR QRPGQGLEWIGQLYPGDDD THYNGKFKGKVTLTADRSS GTAYMQLSRLTSEDSAVYF CAVTEVKRRRSFAYWGQGT LVTVSA | 61 | GYAFTNFW | 181 | LYPGDDD | 301 | AVTEVKRRRSFAYWG | 421 |

TABLE 1B

The amino acid sequences of the light chain variable
region (VL) and IMGT LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-11 | DVVMTQTPLSLPVSLGDQA SISCRSSQSLVHSNGNTYL HWYLQKPGQSPKLLIYKVS NRFSGVPDRFSGSGSGTDF TLKISRVEAEDLGVYFCSQ STLVPPTFGGGTKLEIK | 62 | QSLVHSNGNTY | 182 | KV | 302 | SQSTLVPPTFG | 422 |
| VK-66 | DIVMTQSQKFMSTTAGDRV SITCKASQNVGSAVVWYQQ KPGRSPKLLIYSSSIRYTG VPDRFTGSGSGTDFTLTIN SVQSEDLADYFCQQYNSFP LTFGAGTKLEIK | 63 | QNVGSA | 183 | SS | 303 | QQYNSFPLTFG | 423 |

TABLE 1B-continued

The amino acid sequences of the light chain variable region (VL) and IMGT LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-79 | DVVMTQTPLSLPVSLGDQA SISCRSSQSLVHSNGNTYL HWYLQKPGQSPKLLIYKVS NRFSGVPDRFSGSGSGTDF KLKISRVEAEDLGVYFCSQ STHVPPTFGGGTKLEIK | 64 | QSLVHSNG NTY | 184 | KV | 304 | SQSTHVPPTFG | 424 |
| VK-184 | DVVMTQTPLTLSVTIGQPA SISCKSSQSLLHSNGKTYL NWLLQRPGQSPKRLIYLVS KLDSGVPDRFTGSGSGTDF TLKISRVEAEDLGVYCCVQ GTHVPYTFGGGTKLEIK | 65 | QSLLHSNG KTY | 185 | LV | 305 | VQGTHVPYTFG | 425 |
| VK-184_C_Y | DVVMTQTPLTLSVTIGQPA SISCKSSQSLLHSNGKTYL NWLLQRPGQSPKRLIYLVS KLDSGVPDRFTGSGSGTDF TLKISRVEAEDLGVYYCVQ GTHVPYTFGGGTKLEIK | 66 | QSLLHSNG KTY | 186 | LV | 306 | VQGTHVPYTFG | 426 |
| VK-216_272 | DVVMTQTPLTLSVTIGQPA SISCKSSQSLLDSDGKTYL NWLLQRPGQSPKRLIYLVS KLDSGVPDRFTGSGSGTDF TLKISRVEAEDLGVYYCLQ ATHFPWTFGGGTKLEIK | 67 | QSLLDSDG KTY | 187 | LV | 307 | LQATHFPWTFG | 427 |
| VK-308 | DIVMTQSQNFMSTSVGDRV SVTCKASQYVGTYVAWYQQ KPGQSPKALIYSASYRHTG VPDRFTGSGSGTDFTLTIS NVQSEDLADYFCQQYSSSP YTFGGGTKLEIK | 68 | QYVGTY | 188 | SA | 308 | QQYSSSPYTFG | 428 |
| VK-317 | DIVMTQSPSSLSVSAGEKV TMSCKSSQSLLKSGNQKNY LAWHQQKPGQPPKLLIYGA STRESGVPDRFTGSGSGTD FTLTISSVQAEDLAVYYCQ NDHSHPYTFGGGTKLEIK | 69 | QSLLKSGN QKNY | 189 | GA | 309 | QNDHSHPYTFG | 429 |
| VK-317v2 | DIVMSQSPSSLAVSAGEKV TMSCKSSQSLLNSRTRKNY LAWYQQKPGQSPKLLIYWA STRESGVPDRFTGSGSGTD FTLTISSVQAEDLAVYYCK QSYNLYTFGGGTKLEIK | 70 | QSLLNSRT RKNY | 190 | WA | 310 | KQSYNLYTFG | 430 |
| VK-322 | DIVMTQSQKFMSTTVGDRV SITCKASQNVGAAVVWYQQ KPGQSPKLLIYSASYRYSG VPDRFTGSGSGTDFTLTIS NMQSEDLADYFCQQYNSFP LTFGGGTKLEIK | 71 | QNVGAA | 191 | SA | 311 | QQYNSFPLTFG | 431 |
| VK-329 | DVVMTQTPLSLTVSLGDQA SISCRSSQSLVHSNGNTYL HWYLQKPGQSPKFLIYKVS NRFSGVPDRFSGSGSGTDF RLKISRVEAEDLGVYFCSQ STLVPLTFGAGTKLEIK | 72 | QSLVHSNG NTY | 192 | KV | 312 | SQSTLVPLTFG | 432 |
| VK-330 | DIVMSQSPSSLAVSVGEKV TMSCKSSQSLFNSRTRKNY LAWYQQKPGQSPKLLIYWA STRESGVPDRFTGSGSGTD FTLTINSVQAEDLALYYCN QSYDLLTFGAGTKLEIK | 73 | QSLFNSRT RKNY | 193 | WA | 313 | NQSYDLLTFG | 433 |

TABLE 1B-continued

The amino acid sequences of the light chain variable region (VL) and IMGT LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-332 | DIVMTQSQKFMSSAVGDRV TITCKASQNVGAAVAWYQQ KPGQSPKLLLYSASIRYTG VPDRFTGSGSGTDFTLTIS NIQSEDLAHFFCQQYNSFP LTFGGGTKLEIK | 74 | QNVGAA | 194 | SA | 314 | QQYNSFPLTFG | 434 |
| VK-335 | DIVMTQSQKFMSTTVGDRV SITCKASQNVGAVVWYQQ KPGQSPKLLIYSASYRYTG VPDRFTGSGSGTDFTLTIS NMQSEDVADYFCQQYNSFP LTFGGGTKLEIK | 75 | QNVGAA | 195 | SA | 315 | QQYNSFPLTFG | 435 |
| VK-336v1 | DIVMSQSPSSLAVSAGEKV TMSCKSSQSLLSSRTRKNY LAWYQQKPGQSPKLLIYWA STRESGVPDRFTGSGSGTD FTLTISSVQAEDLALYFCN QSYDLLTFGAGTKLEIK | 76 | QSLLSSRT RKNY | 196 | WA | 316 | NQSYDLLTFG | 436 |
| VK-336v2 | DIVMTQSPATLSVTPGDRV SLSCRASQSISDYLHWYQQ KSHESPRLLIKYASQSISG IPSRFSGSGSGSDFTLSIN SVEPEDVGVYYCQNGHSFP PTFGAGTKLEIK | 77 | QSISDY | 197 | YA | 317 | QNGHSFPPTFG | 437 |
| VK-338v1 | DIVMTQSQKFMSTTLGDRV SIPCKASQSVGAAVAWYQQ KPGQSPKLLIYSASIRYAG VPDRFTGSGSGTDFTLTVS NMRSEDLADYFCQQYNSFP LTFGGGTKLEIK | 78 | QSVGAA | 198 | SA | 318 | QQYNSFPLTFG | 438 |
| VK-338v2 | DIQMTQSSSYLSVSLGGRV TITCKASDHINNWLAWYQQ KPGNAPRLLISGATSLETG VPSRFSGSGSGKDYTLSIT SLQTEDVATYYCQQYWSTP YTFGGGTKLEIK | 79 | DHINNW | 199 | GA | 319 | QQYWSTPYTFG | 439 |
| VK-341v1 | DVVMTQTPLTLSVTIGQPV SISCKSSQSLLESDGKTYL NWLLQRPGESPKLLIYLVS KLDSGVPDRFTGSGSGTDF TLKISRVEAEDLGVFYCLQ ATHFPHTFGGGTKLEIK | 80 | QSLLESDG KTY | 200 | LV | 320 | LQATHFPHTFG | 440 |
| VK-341v2 | DIQMTQSPSSLSASLGERV SLTCRASQEIKTYLSWLQQ KPDGTIKRLIYAATTLESV VPKRFSGSWSGSEYSLTIS SLESEDFADYYCLQYASYP WTFGGGTKLEIK | 81 | QEIKTY | 201 | AA | 321 | LQYASYPWTFG | 441 |
| VK-343 | DVQITQSPSYLAASPGETI TINCRASKSISKYLAWYQE KPGKTNKLLIYSGSTLQSG IPSRFSGSGSGTDFTLTIS SLEPEDFAMYYCQQHDEYP WTFGGGTKLEIK | 82 | KSISKY | 202 | SG | 322 | QQHDEYPWTFG | 442 |
| VK-399 | DIVMTQSQKFMSTSVGDRV SVTCKASQNVGENVSWYQQ KPGQFPKALIYSASYRYSG VPDRFTGSGSGTDFSLTIS NVQSEDLAEYFCQQYNSSP WTFGGGTKLEIK | 83 | QNVGEN | 203 | SA | 323 | QQYNSSPWTFG | 443 |

TABLE 1B-continued

The amino acid sequences of the light chain variable region (VL) and IMGT LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-402 | DVVMTQSPLTLSVTIGQPASISCRSSRSLLDSDGKTKLHWLLQRPGQSPKSLIYLVSKLDSGVPNRFTGGGSGTDFTLKINRVEAEDLGVYYCWQGTHFPWTFGVGTKLEIK | 84 | RSLLDSDGKTK | 204 | LV | 324 | WQGTHFPWTFG | 444 |
| VK-416 | DVVMTQTPLSLPVSLGGQASISCRSSQSLVHSNGNTYLHWYLQKPGQSPKFLIYKVSNRISGVPDRFSGSGSGTDFTLKISRVEAEDLGVYFCSQSTLVPLTFGAGTKLELR | 85 | QSLVHSNGNTY | 205 | KV | 325 | SQSTLVPLTFG | 445 |
| VK-429 | DVVMTQTPLSLPVSLGDQASISCRSSQSLVHSNGNTYLQWYLQKPGQSPKLLIYKVSNRFSGVPDRFSGSGSGTEFTLKIRRVEAEDLGVFLCSQSTLVPLTFGAGTKLELK | 86 | QSLVHSNGNTY | 206 | KV | 326 | SQSTLVPLTFG | 446 |
| VK-430 | DVVMTQTPLSLPVSLGDQVSISCRSSQSLVHSNGNTYLQWYLQKPGQSPKLLIYKVSNRFSGVPDRFSGSGSGTDFTLKISRVEAEDLGVYFCSQSTLVPLTFGAGTKLELR | 87 | QSLVHSNGNTY | 207 | KV | 327 | SQSTLVPLTFG | 447 |
| VK-440 | ENVLTQSPAIMSASPGEKVTITCSASSSVSYMHWFQQKPGTSPKLWIYSTSNLASGVPTRFSGSGSGTSYSLTISRMEAEDAATYYCQQRSSYPPTFGGGAKLEIK | 88 | SSVSY | 208 | ST | 328 | QQRSSYPPTFG | 448 |
| VK-453 | DIVMTQSPSSLAVSVGEKVTMSCKSSQSLFSSRTRKNYLAWYQQKPGQSPKLLIYWASTRESGVPYRFTGSGSGTDFTLTISSVQTEDLAVYYCKQSYNLLTFGAGTKLEL | 89 | QSLFSSRTRKNY | 209 | WA | 329 | KQSYNLLTFG | 449 |
| VK-454 | DVVMTQTPLSLPVSLGDQASISCRSSQSLVHSNGNTYLHWYLQKPGQSPKLLIYRVSNRFSGVPDRFSGSGSGTDFTLKISRVEAEDLGVYFCSQSTHVPPTFGGGTKLEIK | 90 | QSLVHSNGNTY | 210 | RV | 330 | SQSTHVPPTFG | 450 |
| VK-465 | DVVMTQTPLSLPVSLGDQASVSCRSSQSLVHSTGNTFLHWYLQKPGQSPKLLIYKVSNRFSGVPDRFSGSGSGTDFTLKISRVEAEDLGVYFCSQSTLVPLTFGAGTKLELK | 91 | QSLVHSTGNTF | 211 | KV | 331 | SQSTLVPLTFG | 451 |
| VK-475 | DVVMTQTPLSLPVSLGDQASISCRSSQSLVHSNGNTYLHWYLQKPGQSPKLLIYKVSNRFSGLPDRFSGSGSGTDFTLKISRVEAEDLGVYFCSQSTLVPPTFGGGTKLEIK | 92 | QSLVHSNGNTY | 212 | KV | 332 | SQSTLVPPTFG | 452 |
| VK-481 | DVVMTQTPLSLPVSLGDQASISCRSSQSLVHNNGVTYLHWYLQKPGQSPKLLIYKVSNRFSGVPDRFSGSGSGTDFTLKISRVEAEDLGVYFCSQSTHVPITFGAGTKLELK | 93 | QSLVHNNGVTY | 213 | KV | 333 | SQSTHVPITFG | 453 |

TABLE 1B-continued

The amino acid sequences of the light chain variable region (VL) and IMGT LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-497 | DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPFTFGSGTKLEIK | 94 | QSLVHSNGNTY | 214 | KV | 334 | SQSTHVPFTFG | 454 |
| VK-502 | DVVMTQTPLSLPVSLGDQASISCRSSQSLVHSNGNTYLHWYLQKSGQSPKLLIYKVSNRFSGVPDRFSGSGSGTDFTLKISRVEAEDLGVYFCSQSTHVPYTFGGGTKLEIK | 95 | QSLVHSNGNTY | 215 | KV | 335 | SQSTHVPYTFG | 455 |
| VK-503 | DIVLTQSPASLAVSLGQRATISCRASKSVSTSGYSYLHWYQQKPGQPPKLLIYLASNLESGVPARFSGSGSGTDFTLNIHPVEEEDAATYYCQHNRELPPTFGGGTKLEIK | 96 | KSVSTSGYSY | 216 | LA | 336 | QHNRELPPTFG | 456 |
| VK-504 | DVVMTQSPLTLSVTIGQPASISCKSSQSLLYSNGKTYLNWLLQRPGQSPKRLIYLVSKLDSGVPDRFTGSGSGTDFTLKISRVEAEDLGVYYCVQGTHFPHTFGGGTKLEIK | 97 | QSLLYSNGKTY | 217 | LV | 337 | VQGTHFPHTFG | 457 |
| VK-507 | DVVMTQTPLSLPVSLGDHASISCRSSQSLIHSNGNNYLHWYLQKPGQSPKLLIYTVSNRFSGVPDRFSGSGSGTDFTLKISRVEAEDLGVYFCSQSTLVPLTFGSGTKLEIK | 98 | QSLIHSNGNNY | 218 | TV | 338 | SQSTLVPLTFG | 458 |
| VK-508 | DIVMTQSPSSLAMSVGQKVTMSCKSSQSLLNSSSQKNYLAWYQQKPGQSPKLLIYFASTRESGVPDRFIGSGSGTDFTLTISNVQAEDLADYFCQQHYSTPPTFGGGTKLEIK | 99 | QSLLNSSSQKNY | 219 | FA | 339 | QQHYSTPPTFG | 459 |
| VK-510 | DVVMTQTPLSLPVSLGDHASISCRSSQSLIHSNGNNYLHWYLQKPGQSPQLLIYKVSNRFSGVPDRFSGSGSGTDFTLKISRVEAEDLGVYFCSQSTLVPLTFGSGTKLELR | 100 | QSLIHSNGNNY | 220 | KV | 340 | SQSTLVPLTFG | 460 |
| VK-511 | DVVMTQTPLSLPVSLGDHASISCRSSQSLVHSNGNIYLHWYLQRPGQSPKLLIHKVSNRFSGVPDRFSGSGSGTDFTLKISRVEAEDVGIYFCSQSTLVPLTFGSGTKLELK | 101 | QSLVHSNGNIY | 221 | KV | 341 | SQSTLVPLTFG | 461 |
| VK-518 | DVVMTQTPLSLPVSLGDHASISCRSSQSLVHSNGNTYLHWYLQRPGQSPKLLIHKVSNRFSGVPDRFSGSGSGTDFTLKISRVEAEDVGIYFCSQSTLVPLTFGSGTKLELK | 102 | QSLVHSNGNTY | 222 | KV | 342 | SQSTLVPLTFG | 462 |
| VK-528 | DVVMTQTPLSLPVSLGDHASISCRSSQSLIHSNGNNYLHWYLQKPGQSPKLLIYKVSNRFSGVPDRFSGSGSGTDFTLKISRVEAEDLGVYFCSQSTLVPLTFGSGTKLELK | 103 | QSLIHSNGNNY | 223 | KV | 343 | SQSTLVPLTFG | 463 |

TABLE 1B-continued

The amino acid sequences of the light chain variable region (VL) and IMGT LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-521 | DVVMTQSPLSLPVSLGDHASISCRSSQSLIHSNGNNYLHWYLQKPGQSPKLLIYTVSNRFSGVPDRFSGSGSGTDFTLKISRVEAEDLGVYFCSQSTLVPLTFGSGTKLEVK | 104 | QSLIHSNGNNY | 224 | TV | 344 | SQSTLVPLTFG | 464 |
| VK-530 | DVVMTQTPLSLPVSLGDHASISCRSSQSLIHSNGNNYLHWYLQKPGQSPKLLIYTVSNRFSGVPDRFSGSGSGTDFTLKISRVEAEDLGVYFCSQSTLVPLTFGSGTKLEVK | 105 | QSLIHSNGNNY | 225 | TV | 345 | SQSTLVPLTFG | 465 |
| VK-541 | DIVMTQTPLSLPVSLGDQASISCRSSQSLVHSSGNTYLHWYLQKPGQSPKLLIYKVSNRFSGVPDRFSGSGSGTDFTLRISRVAAEDLGVYFCSQSTLVPVTFGAGTELELK | 106 | QSLVHSSGNTY | 226 | KV | 346 | SQSTLVPVTFG | 466 |
| VK-547 | DVVMTQTPLSLPVSLGNQASISCRSSQRLVHSNGNTYLHWYLQKPGQSPKLLIYKVFNRFSGVPDRFSGSGSGTDFTLKISRVEAEDLGIYFCAQSTLVPPTFGGGTKLEIK | 107 | QRLVHSNGNTY | 227 | KV | 347 | AQSTLVPPTFG | 467 |
| VK-549 | DVVMTQTPLSLPVSLGDQASISCRSSQSLVHSSENTYLHWYLQKPGQSPKLLIYKVSNRFSGVPDRFSGSGSGTDFTLKISRVEAEDLGVYFCSQSTLVPVTFGAGTKLELK | 108 | QSLVHSSENTY | 228 | KV | 348 | SQSTLVPVTFG | 468 |
| VK-550 | DVVMTQTPLSLPVSLGNQASISCRSSQSLVHSNGNTYLHWYLQKPGQSPRLLIYKVFNRFSGVPDRFSGSGSGTDFTLKISRVEAEDLGVYFCAQSTLVPPTFGGGTKLEIK | 109 | QSLVHSNGNTY | 229 | KV | 349 | AQSTLVPPTFG | 469 |
| VK-553 | DVVMTQTPLSLPVSLGDQASISCRSSQSLVHSSENTYLHWYVQKPGQSPKLLIYKVSNRFSGVPDRFSGSGSGTDFTLKISRVEAEDLGVYFCSQSTLVPVTFGAGTKLELK | 110 | QSLVHSSENTY | 230 | KV | 350 | SQSTLVPVTFG | 470 |
| VK-556 | DVVMTQTPLSLPVSLGNQASISCRSSQSLVHSNGNTYLHWYLQKPGQSPRLLIYKVFNRFPGVPDRFSGSGSGTDFTLKISRVEAEDLGVYFCAQSTLVPPTFGGGTKLEIK | 111 | QSLVHSNGNTY | 231 | KV | 351 | AQSTLVPPTFG | 471 |
| VK-557 | DVVMTQTPLSLPVSLGDQASISCRSSQSLVHSSGNTYLHWYLQKPGQSPKLLIYKVSNRFSGVPDRFSGSGSGTHFTLKLSRVEAEDLGIYFCSQSTLIPLTFGAGTKLEL | 112 | QSLVHSSGNTY | 232 | KV | 352 | SQSTLIPLTFG | 472 |
| VK-567 | DIQMTQSPSSLSASLGEKVSLTCRASQEISGYLSWLQQKPDGSIKRLIYAASTLDSGVPKRFSGSRSGVYSLTISSLESEDFADYYCLHYANYPPTFGGGTKLEIR | 113 | QEISGY | 233 | AA | 353 | LHYANYPPTFG | 473 |

TABLE 1B-continued

The amino acid sequences of the light chain variable
region (VL) and IMGT LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-568 | DVQMTQSPSSLSASLGDTI TITCHASQNIYVWLNWFQQ KPGNIPKLLISKASDLHTG VPSRFSGSGSGTGFTLTIS SLQPEDIATYYCQQGLSYP LTFGGGTNLEIK | 114 | QNIYVW | 234 | KA | 354 | QQGLSYPLTFG | 474 |
| VK-583 | DVVMTQTPLSPPVSLGYQA SISCRSSQSLVHSNGNTYL NWYLQKPGQSPKLLIYKVS NRLSGVPDRFSGSGSGTDF TLKISRVETEDLGVYFCSQ STHVPYTFGGGTKLEIK | 115 | QSLVHSNG NTY | 235 | KV | 355 | SQSTHVPYTFG | 475 |
| VK-584 | DVVMTQTPLSLPVSLGDRA SISCRSGQSLVHSNGNTYL HWYLQRPGRSPNLLIYKVS NRFSGVPDRFSGSGSGTDF TLKISRVEAEDLGVYFCSQ STHVPWTFGGGTKLEIK | 116 | QSLVHSNG NTY | 236 | KV | 356 | SQSTHVPWTFG | 476 |
| VK-585 | DVVMTQTPLSLPVSLGDQA SISCRFSQSIVYSNGNTYL QWYLQKPGQSPKLLIYKVS NRFSGVPDRFSGSGSGTDF TLKISRVEAEDLGVYYCFQ GSHVPPTFGGGTKLEIK | 117 | QSIVYSNG NTY | 237 | KV | 357 | FQGSHVPPTFG | 477 |
| VK-586 | DVVMTQTPLTLSVTIGQPT SISCKSSQSLLYSNGKTYL SWLLQRPGQSPKRLIYLVS KLDSGVPDRFTGSGSGTDF TLKINRVEAEDLGLYYCVQ NTHLPYTFGGGTKLEIR | 118 | QSLLYSNG KTY | 238 | LV | 358 | VQNTHLPYTFG | 478 |
| VK-588 | DIQMTQSTSSLSASLGDRV TISCRASQDISNYLNWYQQ TPDGTVKLLIYQISRLHSG VPSRFSGSGSGTDYSLTIS NLEEEDIANYFCQQGNSLP PTFGGGTKVEIK | 119 | QDISNY | 239 | QI | 359 | QQGNSLPPTFG | 479 |
| VK-592 | DIQMNQSPSSLSASLGDTI TITCHASQNIDVWLSWYQQ KPGNIPKLLIYKASNLHTG VPSRFSGRDSGTAFTLTIS SLQPEDIATYYCQQGHSYP LTFGSGTKLELK | 120 | QNIDVW | 240 | KA | 360 | QQGHSYPLTFG | 480 |

TABLE 1C

Exemplary VH/VL pairings

| Antibody Molecule Name | VH Name (e.g., as listed in Tables 1A, 2A, and 3A) | VL Name (e.g., as listed in Tables 1B, 2B, and 3B) |
|---|---|---|
| 11 | VH-11 | VK-11 |
| 11v2 | VH-11v2 | VK-11 |
| 66 | VH-66 | VK-66 |
| 79 | VH-79 | VK-79 |
| 184 | VH-184 | VK-184 |
| 184_C_Y | VH-184 | VK-184_C_Y |
| 216 | VH-216 | VK-216_272 |
| 272 | VH-272 | VK-216_272 |
| 308 | VH-308 | VK-308 |
| 317 | VH-317 | VK-317 |
| 317_v2-1 | VH-317v2 | VK-317 |
| 317_v1-2 | VH-317 | VK-317v2 |
| 317_v2 | VH-317v2 | VK-317v2 |
| 322 | VH-322 | VK-322 |
| 322_v2 | VH-322v2 | VK-322 |
| 329 | VH-329 | VK-329 |
| 330 | VH-330 | VK-330 |
| 332 | VH-332 | VK-332 |
| 335 | VH-335 | VK-335 |
| 336_v1 | VH-336v1 | VK-336v1 |
| 336_v1-2 | VH-336v1 | VK-336v2 |
| 336_v2-1 | VH-336v2 | VK-336v1 |
| 336_v2 | VH-336v2 | VK-336v2 |
| 336_v3-1 | VH-336v3 | VK-336v1 |
| 336_v3-2 | VH-336v3 | VK-336v2 |
| 338_v1 | VH-338 | VK-338v1 |

TABLE 1C-continued

Exemplary VH/VL pairings

| Antibody Molecule Name | VH Name (e.g., as listed in Tables 1A, 2A, and 3A) | VL Name (e.g., as listed in Tables 1B, 2B, and 3B) |
|---|---|---|
| 338_v1-2 | VH-338 | VK-338v2 |
| 341_v1 | VH-341v1 | VK-341v1 |
| 341_v1-2 | VH-341v1 | VK-341v2 |
| 341_v2-1 | VH-341v2 | VK-341v1 |
| 341_v2-2 | VH-341v2 | VK-341v2 |
| 343 | VH-343 | VK-343 |
| 399 | VH-399 | VK-399 |
| 402 | VH-402 | VK-402 |
| 416 | VH-416 | VK-416 |
| 429 | VH-429 | VK-429 |
| 430 | VH-430 | VK-430 |
| 440 | VH-440 | VK-440 |
| 453 | VH-453 | VK-453 |
| 454 | VH-454 | VK-454 |
| 465 | VH-465 | VK-465 |
| 475 | VH-475 | VK-475 |
| 481 | VH-481 | VK-481 |
| 497 | VH-497 | VK-497 |
| 502 | VH-502 | VK-502 |
| 503 | VH-503 | VK-503 |
| 503_v2 | VH-503 | VK-503 |
| 504 | VH-504 | VK-504 |
| 507 | VH-507 | VK-507 |
| 508 | VH-508 | VK-508 |
| 510 | VH-510 | VK-510 |
| 511 | VH-511 | VK-511 |
| 511_v2 | VH-511 | VK-511 |
| 518 | VH-511 | VK-518 |
| 518_v2 | VH-511 | VK-518 |
| 528 | VH-510 | VK-528 |
| 521 | VH-521 | VK-521 |
| 530 | VH-530 | VK-530 |
| 536 | VH-536 | VK-530 |
| 541 | VH-541 | VK-541 |
| 547 | VH-547 | VK-547 |
| 549 | VH-549 | VK-549 |
| 550 | VH-550 | VK-550 |
| 553 | VH-553 | VK-553 |
| 556 | VH-556 | VK-556 |
| 557 | VH-557 | VK-557 |
| 567 | VH-567 | VK-567 |
| 568 | VH-568 | VK-568 |
| 570 | VH-570 | VK-567 |
| 573 | VH-573 | VK-567 |
| 583 | VH-583 | VK-583 |
| 584 | VH-584 | VK-584 |
| 585 | VH-585 | VK-585 |
| 586 | VH-586 | VK-586 |
| 588 | VH-588 | VK-588 |
| 592 | VH-592 | VK-592 |

TABLE 2A

The amino acid sequences of the heavy chain variable region (VH) and Chothia HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-11 | QVQLQQSGPELVKPGASVKISCKASGYSFSSSWMNWVKQRPGKGLEWIGRISPGDGDTRYSGKFKGKATLTADKSSSTAYMQVTSLTSEDSAIYFCVRRFLITSTRYVMDYWGQGTTVTVSS | 481 | GYSFSSS | 601 | SPGDGD | 721 | RFLITSTRYVMDY | 841 |
| VH-11v2 | QVQLQQSGPELVKPGASVKISCKASGYSFSSSWMNWVKQRPGKGLEWIGRISPGDGDTRYSGKFKGKATLTADKSSSTAYMQVTSLTSEDSAIYFCVRFLITSTRYVMDYWGQGTTVTVSS | 482 | GYSFSSS | 602 | SPGDGD | 722 | FLITSTRYVMDY | 842 |
| VH-66 | QVQLQQSDAELVKPGASVKISCKASGYTFIDHAIHWVKQRPEQGLEWIGYISPGNGEIKYNEKFKAKATLTADKSSSAAYMQLNSLTSADSAVYFCKRALFYYTGKYQPMDYWGQGTTVTDSS | 483 | GYTFIDH | 603 | SPGNGE | 723 | ALFYYTGKYQPMDY | 843 |
| VH-79 | QVQLKESGPGLVAPSQSLSITCTVSGFSLTSYAISWVRQPPGKGLEWLGVIWTGGGTKYNSALKSRLSISKDNSKSHVFLKMNSLQSDDTARYYCARDGDYVYYAMAYWGQGTTVTVSS | 484 | GFSLTSY | 604 | WTGGG | 724 | DGDYVYYAMAY | 844 |

TABLE 2A-continued

The amino acid sequences of the heavy chain variable region (VH) and Chothia HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-184 | QVQLQQSGAELVKPGASVKISCKASGYAFSRYWMNWVKQRPGKGLEWIGQIYPGDGDTKYNGKFKGKATLTADKSSSTAYMQLNSLTSEDSAVYFCTRSLGVWGTGTTVTVSS | 485 | GYAFSRY | 605 | YPGDGD | 725 | SLGV | 845 |
| VH-216 | QIQLVQSGPELKKPGETVKISCKASGYSFTTFGMSWVKQAPGKVLKWMGWINTYSGVPTYADDFKGRFAFSLETSASTAYLQINNLKNEDTATYFCARGLGRLLAYWGQGTLVTVSA | 486 | GYSFTTF | 606 | NTYSGV | 726 | GLGRLLAY | 846 |
| VH-272 | QVQLQQSGAELVKPGASVKISCKASGYAFSSYWMNWVKQRPGKGLEWIGHIYPGDGDTKYNGKFKGKATLTADKSSSTAYMQVSSLTSEDSAVYFCTRSLGVWGTGTTVTVSS | 487 | GYAFSSY | 607 | YPGDGD | 727 | SLGV | 847 |
| VH-308 | QVQLQQSGAELAKPGASVKMSCKASGYTFTSYWMHWVKQRPGQGLEWIGYINPSSGYTEYNQKFKDKATLTADKSSSTAYMQLSSLTSEDSAVYYCARGMFAMDYWGQGTTVTVSS | 488 | GYTFTSY | 608 | NPSSGY | 728 | GMFAMDY | 848 |
| VH-317 | QVQLQQPGAELVMPGASVKLSCKASGYTFTSYWLHWVRQRPGQGLEWIGEIDPSDGYSNHNQKFKGKATLTVDKSSSTAYMQLSSLTSEDSAVYYCATEGFWGQGTTVTVSS | 489 | GYTFTSY | 609 | DPSDGY | 729 | EGF | 849 |
| VH-317v2 | QVQLQQPGAELVMPGASVKLSCKASGYTFTSYWMHWVKQRPGQGLEWIGEIDPSDSYTNYNQKFKGKATLTVDKSSSTAYMQLSSLTSEDSAVYYCARVAYYSNFGGFAYWGQGTTVTVSS | 490 | GYTFTSY | 610 | DPSDSY | 730 | VAYYSNFGGFAY | 850 |
| VH-322 | QVQLQQSDAALVKPGASVKISCKASGHTFTDHAIHWVKQRPEQGLEWIGYISPGNGDIKYNDKFKGKATLTADKSSSTAYMQLNSLTPEDSAVYFCKGPLFVRGQYYITMDYWGQGTTVTVSS | 491 | GHTFTDH | 611 | SPGNGD | 731 | PLFVRGQYYITMDY | 851 |
| VH-329 | QVQLQQSGAELTKPGASVKLSCKASGYTFTNYWMHWVKQRPGQGLEWIGYLNPSSGYTKYNQKFKDKATLTADKSSSTAYMQLNSLTYEDSAVYYCTRSGGDNYGNPYYFDRWGQGTTVTVSS | 492 | GYTFTNY | 612 | NPSSGY | 732 | SGGDNYGNPYYFDR | 852 |
| VH-330 | QVQLKQSGPGLVQPSQSLSIACTVSGFSLTSYGVHWVRQSPGKGLEWLGVIWRGGSTDYNAAFKSRLSITKDNSKSQVFFTMNRLHADDTAIYYCAKNSQLGNAMDYWGQGTTVTVSS | 493 | GFSLTSY | 613 | WRGGS | 733 | NSQLGNAMDY | 853 |

TABLE 2A-continued

The amino acid sequences of the heavy chain variable region (VH) and Chothia HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-332 | QVQLQQSDAELVKPGASVK ISCKASGYTFTDHSIHWVK QRPEQGLEWIGYISPGNGD IKYDEKFKGKATLTADTSS STAYMQLNSLTSEDSAVYF CKGPLLLRWRYFYPVDYWG QGTTVTVSS | 494 | GYTFTDH | 614 | SPGNGD | 734 | PLLLRWRYFYPVDY | 854 |
| VH-335 | QVQLQQSDAALVKPGASVK ISCKASGYTFTDHAIHWVK QRPEQGLEWIGYISPGNGD IKYNEKFKGKATLTADKSS STAYMQLNSLTSEDSAVYF CKGPLLVRWRYYITMDYWG QGTTVTVSS | 495 | GYTFTDH | 615 | SPGNGD | 735 | PLLVRWRYYITMDY | 855 |
| VH-336v1 | EVKLEESGGGLVQPGGSMK LSCAASGFTFSDAWMDWVR QSPEKGLEWVAEIRNKANN HATYYAESVKGRFTISRDD SKSSVYLQMNSLRAEDTGI YYCTRGGYYVFAYWGQGTT VTVSS | 496 | GFTFSDA | 616 | RNKANNHA | 736 | GGYYVFAY | 856 |
| VH-336v2 | QVQLKQSGPGLVQSSQSLS ITCTVSGFSLISYGVHWVR QSPGKGLEWLGVIWSGGST DYNAAFKSRLSITKDNSKS QVFFKMNSLQADDTAIYYC AKNSQLGNAMDYWGQGTTV TVSS | 497 | GFSLISY | 617 | WSGGS | 737 | NSQLGNAMDY | 857 |
| VH-336v3 | QVQLQQPGAELVKPGASVK LSCKASGYTFTSYWMHWVK QRPGQGLEWIGMIHPNSNS TNYNEKFKSKATLTVDKSS STAYMQLSSLTSEDSAVYY CARSLTGTKTYWGQGTTVT VSS | 498 | GYTFTSY | 618 | HPNSNS | 738 | SLTGTKTY | 858 |
| VH-338 | EVQLQQSGPELVKPGASVK MSCKASGYTFTDYNMHWVK QSHGKSLEWIGYINPNNGG TSYNQKFKGKATLTVNKSS STAYMELRSLTSEDSAVYY CAHGEGDYAYWGQGTTVTV SS | 499 | GYTFTDY | 619 | NPNNGG | 739 | GEGDYAY | 859 |
| VH-341v1 | EFQLQQSGPELVKPGASVK MSCKASGYTFTKYVIHWVK QKPGQGLEWIGYINPYNDG TKYNEKFKGKARLTSDKSS NTVYMDLSSLTSEDSAVYY CATARATSYWGQGTTVTVS S | 500 | GYTFTKY | 620 | NPYNDG | 740 | ARATSY | 860 |
| VH-341v2 | QVQLQQPGAEFVKPGASVK MSCKASGYSFTSYWITWLK QRPGQGLEWIGDIYPGRGT TDYNEKLKSRATLTVDTSS TTAYMQLSSLTSEDSAVYY CARWGTTGRSYWGQGTTVT VSS | 501 | GYSFTSY | 621 | YPGRGT | 741 | WGTTGRSY | 861 |
| VH-343 | QVQLQQSGAELVKPGASVK LSCKASGYTFTEYTIHWVN QRSGQGLEWIGWFYPGSGS IKYNEKFKDKATLTADKSS HTVYMELSRLTSEDSAVYF CARHGNYYDGSWFAYWGQG TLVTVSA | 502 | GYTFTEY | 622 | YPGSGS | 742 | HGNYYDGSWFAY | 862 |

TABLE 2A-continued

The amino acid sequences of the heavy chain variable region (VH) and Chothia HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|------|-------------|------------|-------|------------|-------|------------|-------|------------|
| VH-399 | EVQLVESGGDLVKPGGSLK LSCAASGFTFSNYGMSWVR QTPDKRLEWVATITSGGTH TYYPDSVKGRFTISRDNAK NTLYLQMSSLKSEDTAMYY CTRHGAYYSNPWFAYWGQG TLVTVS | 503 | GFTFSNY | 623 | TSGGTH | 743 | HGAYYSNPWFAY | 863 |
| VH-402 | QIQLVQSGPELKKPGETVK ISCKASGYTFTTFGMSWVK QAPGKGLKWMGWINTNSGM PTYTDDFRGRFAFSLETSA STAYLQISSLKNEDTATYF CARKSLFYWGQGTTLTVSS | 504 | GYTFTTF | 624 | NTNSGM | 744 | KSLFY | 864 |
| VH-416 | QVQLQQSGAELAKPGASVK LSCKASGYTFISYWMHWVK QRPGQGLEWIGYINPRSDY AKYNQKFKDKATLTTNKSS STAYMQLSSLTYEDYAVYY CARVTGTEGPYYFDYWGQG TTLTVSS | 505 | GYTFISY | 625 | NPRSDY | 745 | VTGTEGPYYFDY | 865 |
| VH-429 | QVQLQQSGAELAKPGASVK LSCKASGYTFSSYWIHWVK QRPGQGLEWIGYINPRGDY TKYNQKFKDKATLTADKSS STAFMQLSSLTYEDSAVYY CVRVTGSEGPYYFDYWGQG TTLTVSS | 506 | GYTFSSY | 626 | NPRGDY | 746 | VTGSEGPYYFDY | 866 |
| VH-430 | QVQLQQSGADLAKPGASVK LSCKASGYTFTSYWIHWVK QRPGQGLEWIGYINPRGDY TKYNQKFKDKATLTADRSS STAYMQLSSLTYEDYAVYY CARVTGTEGPYYFDYWGQG TTLTVSS | 507 | GYTFTSY | 627 | NPRGDY | 747 | VTGTEGPYYFDY | 867 |
| VH-440 | QIQLVQSGPELKKPGETVK ISCKASGYTFTAYGMSWVK QTPGKGLKWMGWINTYSGV PANADDFKGRFAFSLETSA STAYLQINNLKNEDTATYF CARSRYDGYFDYWGQGTTL TVSS | 508 | GYTFTAY | 628 | NTYSGV | 748 | SRYDGYFDY | 868 |
| VH-453 | QVQLKQSGPGQVAPSQSLS ITCTVSGFSLINSAVHWVR QSPGKGLEWLGVIWSDGST DYNTAFISRLSISRDNSKS QVFFKMRSLQVDDTAVYYC ARNGRLGNAMDYWGQGTSV TVSS | 509 | GFSLINS | 629 | WSDGS | 749 | NGRLGNAMDY | 869 |
| VH-454 | QVQLKQSGPGLVAPSQSLS ITCTVSGFSLTSYGVDWIR QSPGKGLEWLGVIWGVGST NYNSALKSRLSISKDNSRS QVFLKLNSLQTDDTAMYYC ASPYYSHYVPFAYWGQGTL VTVSA | 510 | GFSLTSY | 630 | WGVGS | 750 | PYYSHYVPFAY | 870 |
| VH-465 | QVQLQQSGAELAKPGASVK LSCKASGYIFTSYWMNWVK QRPGQGLEWIGYINPSTTS TKYNQKFKDKATLTADKSS TTAYMQLTSLTYEDSAVYY CARPDNSGYVGFAYWGQGT LVTVSA | 511 | GYIFTSY | 631 | NPSTTS | 751 | PDNSGYVGFAY | 871 |

TABLE 2A-continued

The amino acid sequences of the heavy chain variable
region (VH) and Chothia HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-475 | QVQLKQSGPGLVAPSQSLS ITCTVSGFSLTSYGVDWIR QSPGKGLEWLGVIWGVGGT NYNSALKSRLSISKDNSRS QVFLKLNSLQTDDTAMYYC ASPYYSHYVPFAYWGQGTL VTVSA | 512 | GFSLTSY | 632 | WGVGG | 752 | PYYSHYVPFAY | 872 |
| VH-481 | QVQLQQSGAELAKPGASVQ VSCKASGYSFTRYWMHWIK QRPGQGLEWIGYINPSTDY SAYNQKFKDKATLTADKSS STAYLQLTSLTSEDSAVYY CAGGLPHFDYWGQGTTLTV SS | 513 | GYSFTRY | 633 | NPSTDY | 753 | GLPHFDY | 873 |
| VH-497 | QVQLKQSGPGLVAPSQSLS ITCTVSGFSLTTYGVHWVR QPPGKGLEWLVVIWSDGST TYNSALKSRLSISKDNSKS QVFLKMNSLQPDDTAMYYC ARNSRYGNSFAYWGQGTLV TVSA | 514 | GFSLTTY | 634 | WSDGS | 754 | NSRYGNSFAY | 874 |
| VH-502 | DVQLQESGPDLVKPSQSLS LTCTVTGYSITSGYSWHWI RQFPGNKLEWMGYIHYSGS TNYNPSLKSRISITRDTSK NQFFLQLKSVTTEDTATYY CVFWLPFDYWGQGTTLTVS S | 515 | GYSITSGY | 635 | HYSGS | 755 | WLPFDY | 875 |
| VH-503 | DVQLQESGPGLVKPFQSLS LTCTVTGYSITSDYAWNWI RQFPGNKLEWMGYINYSGS TSYNPSLRSRISITRDTSK NQFFLHLNSVTTEDTATYY CARMGYRYPWFAYWGQGTL VTVSA | 516 | GYSITSDY | 636 | NYSGS | 756 | MGYRYPWFAY | 876 |
| VH-504 | EVQLKQSGGGLVKPGGSLK LSCAASGFTFSSYTMSWVR QTPEKRLEWVATISSGGSY TYYPDSVKGRFTISRDNAK NTLYLQMSSLKSEDTAMYY CTRGGGNYDAMDYWGQGTS VTVSS | 517 | GFTFSSY | 637 | SSGGSY | 757 | GGGNYDAMDY | 877 |
| VH-507 | QVQLQQSGAELAKPGASVK LSCKASGYTFTNYWMHWVK QRPGQGLEWIGYINPSSAS SKYNQKFKDRATLTTDKSS STAFMHLSSLTYEDSAVYY CARVPLPYGSSYGPYFFDF WGQGTTLTVSS | 518 | GYTFTNY | 638 | NPSSAS | 758 | VPLPYGSSYGPYFF DF | 878 |
| VH-508 | QVQLQQSGAELARPGASVK MSCKASGYTFTSYTMHWVK QRPGQGLEWIGYINPSSGY TKYNQKFKDKATLTADKSS STAYMQLSSLTSEDSAVYY CARSGDYDGFAYWGQGTLV TVSA | 519 | GYTFTSY | 639 | NPSSGY | 759 | SGDYDGFAY | 879 |
| VH-510 | QVQLQQSGAELAKPGASVK LSCKASGYTFTSYWMHWVK QRPGQGLEWIGYINPSSGY TKYNQKFKDRATLTADKSS STAYMQLSSLTYEDSAVYY CARVPLSYGSSYGPYFFDY WGQGTTLTVSS | 520 | GYTFTSY | 640 | NPSSGY | 760 | VPLSYGSSYGPYFF DY | 880 |

TABLE 2A-continued

The amino acid sequences of the heavy chain variable region (VH) and Chothia HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-511 | QVQLQQSGAELAKPGASVKLSCKTSGYTFTNYWMHWIKQRPGLGLEWIGYINPSGDYTKHNQKFKDKATLTADRSSSTAYMQLSSLTYEDSAVYYCARVPLSYGSGNGPYYFDYWGQGTTLTVSS | 521 | GYTFTNY | 641 | NPSGDY | 761 | VPLSYGSGNGPYYFDY | 881 |
| VH-521 | QVQLQQSRAALAKPGASVKLSCKASGYTFTNHWMHWVKQRPGQGLEWIGYINPINGFNRYNQNFKDRATLTTDKASSTAFIHLNGLTYEDFAVYYCARVPLSYGGSYGPYFFDFWGQGTILTVSS | 522 | GYTFTNH | 642 | NPINGF | 762 | VPLSYGGSYGPYFFDF | 882 |
| VH-530 | QVQLQQSRAALAKPGASVKLSCKASGYTFTNHWLHWVKQRPGQGLEWIGYINPINGFSKYNQNFKNRATLTTDSSSSTAFIHLSGLTYEDFAVYYCARVPLSYGGSYGPYFFDFWGQGTILTVSS | 523 | GYTFTNH | 643 | NPINGF | 763 | VPLSYGGSYGPYFFDF | 883 |
| VH-536 | QVQLQQSGAALAKPGASVKLSCKASGYSFTNYWMHWVKQRPGQGLEWIGYINPINGYGKYNQNFKDRATLTTDKSSSTAFIHLSGLTYEDSAVYYCARVPLSYGGSYGPYFFDFWGQGTILTVSS | 524 | GYSFTNY | 644 | NPINGY | 764 | VPLSYGGSYGPYFFDF | 884 |
| VH-541 | QVQLQQSGPELVKPGESVKMSCKASGYTFTDYYMDWVKQSHGKSLEWIGYFYPNNGGVKYSQKFKDKAALTVDKSSTTAYMELHSLTFEDSAVYYCTRGSGPFAYWGQGTLVTVSA | 525 | GYTFTDY | 645 | YPNNGG | 765 | GSGPFAY | 885 |
| VH-547 | QVQLKQSGPGLVAPSQSLSITCTVSGFSLTNYGVDWVRQSPGKGLEWLGVIWGDGITKYNSALKSRLSISKDNSKSQVFLKMNSLQTDDTAMYYCASALDYSNYGFAYWGQGTLVTVSA | 526 | GFSLTNY | 646 | WGDGI | 766 | ALDYSNYGFAY | 886 |
| VH-549 | QVQLQQSGPELVKPGDSVKMSCKVSGYTFTDYYIDWVKQSHGKSLEWIGYFYPNNGGAKYNQKFKSKAALTVDKSSTTAYMELHSLTFEDSAVYYCTRGSGPFAYWGQGTLVTVSA | 527 | GYTFTDY | 647 | YPNNGG | 767 | GSGPFAY | 887 |
| VH-550 | QVQLKQSGPGLVAPSQSLSITCTVSGFSLTNCGVDWVRQSPGKSLEWLGVIWGDGLTKYNSALKSRLSISKDNSKSQVFLKVNSLQTDDTAVYYCASALDYSNYGFAYWGQGTLVTVSA | 528 | GFSLTNC | 648 | WGDGL | 768 | ALDYSNYGFAY | 888 |
| VH-553 | QVQLQQSGPELVKPGDSVKMSCKASGYTFTDYYMDWVKQSHGKSLEWIGYFYPNNGGAKYNQKFKGKAALTVDKSSTTAYMELHSLTFEDSAVYYCTRGSGPFAYWGQGTLVTVSA | 529 | GYTFTDY | 649 | YPNNGG | 769 | GSGPFAY | 889 |

TABLE 2A-continued

The amino acid sequences of the heavy chain variable region (VH) and Chothia HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-556 | QVQLKQSGPGLVAPSQSLSITCTVSGFSLTNCGVDWVRQSPGKSLEWLGVIWGDGLTKYNSALKSRLSISKDNSKSQVFLKVNRLQTDDTAMYYCASALDYSNFGFAYWGQGTLVTVSA | 530 | GFSLTNC | 650 | WGDGL | 770 | ALDYSNFGFAY | 890 |
| VH-557 | QVQLQQSGPELVKPGDSVKMSCKASGYTFSDYYMDWVKQSHGKSLEWIGYFPNNDGIRYNQRFKGRASLTVDKSSNTAYMELHSLTSEDSAVYYCARGSGPFVYWGQGTLVTVSA | 531 | GYTFSDY | 651 | YPNNDG | 771 | GSGPFVY | 891 |
| VH-567 | DVQLQESGPGLVKPSQSLSLTCTVTGYSITSDSAWNWIRQFPGNKLEWMGYISYSGRISYNPSLKSRISITRDTSKNQFFLQFNSVTTEDTAKYYCARASIGFDYWGQGTTLTVSS | 532 | GYSITSDS | 652 | SYSGR | 772 | ASIGFDY | 892 |
| VH-568 | EVQLQQSGADLVKPGASVKLSCTVSGFNIKDSYIHWLKQRPGQGLEWIGRIDPTNVNTKYDPKFQGKASITTDTSSNTAYLQLSSLTSENTAVYYCARRLRQTYAMDYWGQGTSVTVSS | 533 | GFNIKDS | 653 | DPTNVN | 773 | RLRQTYAMDY | 893 |
| VH-570 | DVQLQESGPGLVKPSQSLSLTCTVTGYSITSDSAWNWIRQFPGNKLEWMGYISYSGRISYNPSLKSRISITRDTSKNQIFLQFNSVTTEDTAKYYCARASIGFDYWGQGTTLTVSS | 534 | GYSITSDS | 654 | SYSGR | 774 | ASIGFDY | 894 |
| VH-573 | DVQLQESGPGLVKPSQSLSLTCTVTGYSITSDSAWNWIRQFPGNKLEWMGYISYSGRISYNPSLKSRISITRDTSKNQFFLQFYSVTTEDTARYYCARASIGFDYWGQGTTLTVSS | 535 | GYSITSDS | 655 | SYSGR | 775 | ASIGFDY | 895 |
| VH-583 | EVQLVESGGGLVKPGGSLKLSCAASGFTFNAYAMSWVRQTPEKRLEWVASISTGGNTYCPDSVKDRFTVSRDNVRNILYLQMSSLRSEDTAMYYCTRGYQRFSGFAYWGQGTLVTVSA | 536 | GFTFNAY | 656 | STGGN | 776 | GYQRFSGFAY | 896 |
| VH-584 | DVQLQESGPDLVKPSQSLSLTCTVTGYSITSGYSWHWIRQSPGNKLEWLAYIHNSGSTNYNPSLKSRISITRDTSKNQFFLKLNSVTTEDTATYYCARSIGDYWGQGTTLAVSS | 537 | GYSITSGY | 657 | HNSGS | 777 | SIGDY | 897 |
| VH-585 | DVQLQESGPGLVKPSQSLSLTCTVTGYSITSDYAWNWIRQFPGNKLEWMGYISYSGSTSYNPSLKSRISITRDTSKNQFFLQLSSVTTEDTATYYCARYGGNYPTYAMDYWGQGTSVTVSS | 538 | GYSITSDY | 658 | SYSGS | 778 | YGGNYPTYAMDY | 898 |

TABLE 2A-continued

The amino acid sequences of the heavy chain variable
region (VH) and Chothia HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-586 | DVQLQESGPDLVKPSQSLSLTCIVAGFSLTDSYSWHWIRQFPGNKLEWMGYIHYSGRTNYNPSLKTQFSITRNTSKNQFFLQLISVPTEDTATYYCARYDFAYWGRGTSVTVSS | 539 | GFSLTDSY | 659 | HYSGR | 779 | YDFAY | 899 |
| VH-588 | DVQLQESGPGLVKPSQSLSLTCTVTGYSITSDYAWNWIRQFPGNKLEWMGYISYSGSIRYNPSLKSRISITRDTSKNQFFLQLNSVTTEDTATYYCAITTGGYFDYWGQGTTLTVSS | 540 | GYSITSDY | 660 | SYSGS | 780 | TTGGYFDY | 900 |
| VH-592 | QVQLKQSGAELVRPGSSVGISCKASGYAFTNFWMNWVRQRPGQGLEWIGQLYPGDDDTHYNGKFKGKVTLTADRSSGTAYMQLSRLTSEDSAVYFCAVTEVKRRRSFAYWGQGTLVTVSA | 541 | GYAFTNF | 661 | YPGDDD | 781 | TEVKRRRSFAY | 901 |

TABLE 2B

The amino acid sequences of the light chain variable region (VL) and
Chothia LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-11 | DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTLVPPTFGGGTKLEIK | 542 | RSSQSLVHSNGNTYLH | 662 | KVSNRFS | 782 | SQSTLVPPT | 902 |
| VK-66 | DIVMTQSQKFMSTTAGDRVSITCKASQNVGSAVVWYQQKPGRSPKLLIYSSSIRYTGVPDRFTGSGSGTDFTLTINSVQSEDLADYFCQQYNSFPLTFGAGTKLEIK | 543 | KASQNVGSAVV | 663 | SSSIRYT | 783 | QQYNSFPLT | 903 |
| VK-79 | DVVMTQTPLSLPVSLGDQASISCRSSQSLVHSNGNTYLHWYLQKPGQSPKLLIYKVSNRFSGVPDRFSGSGSGTDFKLKISRVEAEDLGVYFCSQSTHVPPTFGGGTKLEIK | 544 | RSSQSLVHSNGNTYLH | 664 | KVSNRFS | 784 | SQSTHVPPT | 904 |
| VK-184 | DVVMTQTPLTLSVTIGQPASISCKSSQSLLHSNGKTYLNWLLQRPGQSPKRLIYLVSKLDSGVPDRFTGSGSGTDFTLKISRVEAEDLGVYCCVQGTHVPYTFGGGTKLEIK | 545 | KSSQSLLHSNGKTYLN | 665 | LVSKLDS | 785 | VQGTHVPYT | 905 |
| VK-184_C | YDVVMTQTPLTLSVTIGQPASISCKSSQSLLHSNGKTYLNWLLQRPGQSPKRLIYLVSKLDSGVPDRFTGSGSGTDFTLKISRVEAEDLGVYYCVQGTHVPYTFGGGTKLEIK | 546 | KSSQSLLHSNGKTYLN | 666 | LVSKLDS | 786 | VQGTHVPYT | 906 |

TABLE 2B-continued

The amino acid sequences of the light chain variable region (VL) and
Chothia LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-216_272 | DVVMTQTPLTLSVTIGQPA SISCKSSQSLLDSDGKTYL NWLLQRPGQSPKRLIYLVS KLDSGVPDRFTGSGSGTDF TLKISRVEAEDLGVYYCLQ ATHFPWTFGGGTKLEIK | 547 | KSSQSLLDSDGKTY LN | 667 | LVSKLDS | 787 | LQATHFPWT | 907 |
| VK-308 | DIVMTQSQNFMSTSVGDRV SVTCKASQYVGTYVAWYQQ KPGQSPKALIYSASYRHTG VPDRFTGSGSGTDFTLTIS NVQSEDLADYFCQQYSSSP YTFGGGTKLEIK | 548 | KASQYVGTYVA | 668 | SASYRHT | 788 | QQYSSSPYT | 908 |
| VK-317 | DIVMTQSPSSLSVSAGEKV TMSCKSSQSLLKSGNQKNY LAWHQQKPGQPPKLLIYGA STRESGVPDRFTGSGSGTD FTLTISSVQAEDLAVYYCQ NDHSHPYTFGGGTKLEIK | 549 | KSSQSLLKSGNQKN YLA | 669 | GASTRES | 789 | QNDHSHPYT | 909 |
| VK-317v2 | DIVMSQSPSSLAVSAGEKV TMSCKSSQSLLNSRTRKNY LAWYQQKPGQSPKLLIYWA STRESGVPDRFTGSGSGTD FTLTISSVQAEDLAVYYCK QSYNLYTFGGGTKLEIK | 550 | KSSQSLLNSRTRKN YLA | 670 | WASTRES | 790 | KQSYNLYT | 910 |
| VK-322 | DIVMTQSQKFMSTTVGDRV SITCKASQNVGAAVVWYQQ KPGQSPKLLIYSASYRYSG VPDRFTGSGSGTDFTLTIS NMQSEDLADYFCQQYNSFP LTFGGGTKLEIK | 551 | KASQNVGAAVV | 671 | SASYRYS | 791 | QQYNSFPLT | 911 |
| VK-329 | DVVMTQTPLSLTVSLGDQA SISCRSSQSLVHSNGNTYL HWYLQKPGQSPKFLIYKVS NRFSGVPDRFSGSGSGTDF RLKISRVEAEDLGVYFCSQ STLVPLTFGAGTKLEIK | 552 | RSSQSLVHSNGNTY LH | 672 | KVSNRFS | 792 | SQSTLVPLT | 912 |
| VK-330 | DIVMSQSPSSLAVSVGEKV TMSCKSSQSLFNSRTRKNY LAWYQQKPGQSPKLLIYWA STRESGVPDRFTGSGSGTD FTLTINSVQAEDLALYYCN QSYDLLTFGAGTKLEIK | 553 | KSSQSLFNSRTRKN YLA | 673 | WASTRES | 793 | NQSYDLLT | 913 |
| VK-332 | DIVMTQSQKFMSSAVGDRV TITCKASQNVGAAVAWYQQ KPGQSPKLLLYSASIRYTG VPDRFTGSGSGTDFTLTIS NIQSEDLAHFFCQQYNSFP LTFGGGTKLEIK | 554 | KASQNVGAAVA | 674 | SASIRYT | 794 | QQYNSFPLT | 914 |
| VK-335 | DIVMTQSQKFMSTTVGDRV SITCKASQNVGAAVVWYQQ KPGQSPKLLIYSASYRYTG VPDRFTGSGSGTDFTLTIS NMQSEDVADYFCQQYNSFP LTFGGGTKLEIK | 555 | KASQNVGAAVV | 675 | SASYRYT | 795 | QQYNSFPLT | 915 |
| VK-336v1 | DIVMSQSPSSLAVSAGEKV TMSCKSSQSLLSSRTRKNY LAWYQQKPGQSPKLLIYWA STRESGVPDRFTGSGSGTD FTLTISSVQAEDLALYFCN QSYDLLTFGAGTKLEIK | 556 | KSSQSLLSSRTRKN YLA | 676 | WASTRES | 796 | NQSYDLLT | 916 |

TABLE 2B-continued

The amino acid sequences of the light chain variable region (VL) and Chothia LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-336v2 | DIVMTQSPATLSVTPGDRVSLSCRASQSISDYLHWYQQKSHESPRLLIKYASQSISGIPSRFSGSGSGSDFTLSINSVEPEDVGVYYCQNGHSFPPTFGAGTKLEIK | 557 | RASQSISDYLH | 677 | YASQSIS | 797 | QNGHSFPPT | 917 |
| VK-338v1 | DIVMTQSQKFMSTTLGDRVSIPCKASQSVGAAVAWYQQKPGQSPKLLIYSASIRYAGVPDRFTGSGSGTDFTLTVSNMRSEDLADYFCQQYNSFPLTFGGGTKLEIK | 558 | KASQSVGAAVA | 678 | SASIRYA | 798 | QQYNSFPLT | 918 |
| VK-338v2 | DIQMTQSSSYLSVSLGGRVTITCKASDHINNWLAWYQQKPGNAPRLLISGATSLETGVPSRFSGSGSGKDYTLSITSLQTEDVATYYCQQYWSTPYTFGGGTKLEIK | 559 | KASDHINNWLA | 679 | GATSLET | 799 | QQYWSTPYT | 919 |
| VK-341v1 | DVVMTQTPLTLSVTIGQPVSISCKSSQSLLESDGKTYLNWLLQRPGESPKLLIYLVSKLDSGVPDRFTGSGSGTDFTLKISRVEAEDLGVFYCLQATHFPHTGGGTKLEIK | 560 | KSSQSLLESDGKTYLN | 680 | LVSKLDS | 800 | LQATHFPHT | 920 |
| VK-341v2 | DIQMTQSPSSLSASLGERVSLTCRASQEIKTYLSWLQQKPDGTIKRLIYAATTLESVVPKRFSGSWSGSEYSLTISSLESEDFADYYCLQYASYPWTFGGGTKLEIK | 561 | RASQEIKTYLS | 681 | AATTLES | 801 | LQYASYPWT | 921 |
| VK-343 | DVQITQSPSYLAASPGETITINCRASKSISKYLAWYQEKPGKTNKLLIYSGSTLQSGIPSRFSGSGSGTDFTLTISSLEPEDFAMYYCQQHDEYPWTFGGGTKLEIK | 562 | RASKSISKYLA | 682 | SGSTLQS | 802 | QQHDEYPWT | 922 |
| VK-399 | DIVMTQSQKFMSTSVGDRVSVTCKASQNVGENVSWYQQKPGQFPKALIYSASYRYSGVPDRFTGSGSGTDFSLTISNVQSEDLAEYFCQQYNSSPWTFGGGTKLEIK | 563 | KASQNVGENVS | 683 | SASYRYS | 803 | QQYNSSPWT | 923 |
| VK-402 | DVVMTQSPLTLSVTIGQPASISCRSSRSLLDSDGKTKLHWLLQRPGQSPKSLIYLVSKLDSGVPNRFTGGGSGTDFTLKINRVEAEDLGVYYCWQGTHFPWTFGVGTKLEIK | 564 | RSSRSLLDSDGKTKLH | 684 | LVSKLDS | 804 | WQGTHFPWT | 924 |
| VK-416 | DVVMTQTPLSLPVSLGGQASISCRSSQSLVHSNGNTYLHWYLQKPGQSPKFLIYKVSNRISGVPDRFSGSGSGTDFTLKISRVEAEDLGVYFCSQSTLVPLTFGAGTKLELR | 565 | RSSQSLVHSNGNTYLH | 685 | KVSNRIS | 805 | SQSTLVPLT | 925 |
| VK-429 | DVVMTQTPLSLPVSLGDQASISCRSSQSLVHSNGNTYLQWYLQKPGQSPKLLIYKVSNRFSGVPDRFSGSGSGTEFTLKIRRVEAEDLGVFLCSQSTLVPLTFGAGTKLELK | 566 | RSSQSLVHSNGNTYLQ | 686 | KVSNRFS | 806 | SQSTLVPLT | 926 |

TABLE 2B-continued

The amino acid sequences of the light chain variable region (VL) and
Chothia LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-430 | DVVMTQTPLSLPVSLGDQV SISCRSSQSLVHSNGNTYL QWYLQKPGQSPKLLIYKVS NRFSGVPDRFSGSGSGTDF TLKISRVEAEDLGVYFCSQ STLVPLTFGAGTKLELR | 567 | RSSQSLVHSNGNTY LQ | 687 | KVSNRFS | 807 | SQSTLVPLT | 927 |
| VK-440 | ENVLTQSPAIMSASPGEKV TITCSASSSVSYMHWFQQK PGTSPKLWIYSTSNLASGV PTRFSGSGSGTSYSLTISR MEAEDAATYYCQQRSSYPP TFGGGAKLEIK | 568 | SASSSVSYMH | 688 | STSNLAS | 808 | QQRSSYPPT | 928 |
| VK-453 | DIVMTQSPSSLAVSVGEKV TMSCKSSQSLFSSRTRKNY LAWYQQKPGQSPKLLIYWA STRESGVPYRFTGSGSGTD FTLTISSVQTEDLAVYYCK QSYNLLTFGAGTKLEL | 569 | KSSQSLFSSRTRKN YLA | 689 | WASTRES | 809 | KQSYNLLT | 929 |
| VK-454 | DVVMTQTPLSLPVSLGDQA SISCRSSQSLVHSNGNTYL HWYLQKPGQSPKLLIYRVS NRFSGVPDRFSGSGSGTDF TLKISRVEAEDLGVYFCSQ STHVPPTFGGGTKLEIK | 570 | RSSQSLVHSNGNTY LH | 690 | RVSNRFS | 810 | SQSTHVPPT | 930 |
| VK-465 | DVVMTQTPLSLPVSLGDQA SVSCRSSQSLVHSTGNTFL HWYLQKPGQSPKLLIYKVS NRFSGVPDRFSGSGSGTDF TLKISRVEAEDLGVYFCSQ STLVPLTFGAGTKLELK | 571 | RSSQSLVHSTGNTF LH | 691 | KVSNRFS | 811 | SQSTLVPLT | 931 |
| VK-475 | DVVMTQTPLSLPVSLGDQA SISCRSSQSLVHSNGNTYL HWYLQKPGQSPKLLIYKVS NRFSGLPDRFSGSGSGTDF TLKISRVEAEDLGVYFCSQ STLVPPTFGGGTKLEIK | 572 | RSSQSLVHSNGNTY LH | 692 | KVSNRFS | 812 | SQSTLVPPT | 932 |
| VK-481 | DVVMTQTPLSLPVSLGDQA SISCRSSQSLVHNNGVTYL HWYLQKPGQSPKLLIYKVS NRFSGVPDRFSGSGSGTDF TLKISRVEAEDLGVYFCSQ STHVPITFGAGTKLELK | 573 | RSSQSLVHNNGVTY LH | 693 | KVSNRFS | 813 | SQSTHVPIT | 933 |
| VK-497 | DVVMTQTPLSLPVSLGDQA SISCRSSQSLVHSNGNTYL HWYLQKPGQSPKLLIYKVS NRFSGVPDRFSGSGSGTDF TLKISRVEAEDLGVYFCSQ STHVPFTFGSGTKLEIK | 574 | RSSQSLVHSNGNTY LH | 694 | KVSNRFS | 814 | SQSTHVPFT | 934 |
| VK-502 | DVVMTQTPLSLPVSLGDQA SISCRSSQSLVHSNGNTYL HWYLQKSGQSPKLLIYKVS NRFSGVPDRFSGSGSGTDF TLKISRVEAEDLGVYFCSQ STHVPYTFGGGTKLEIK | 575 | RSSQSLVHSNGNTY LH | 695 | KVSNRFS | 815 | SQSTHVPYT | 935 |
| VK-503 | DIVLTQSPASLAVSLGQRA TISCRASKSVSTSGYSYLH WYQQKPGQPPKLLIYLASN LESGVPARFSGSGSGTDFT LNIHPVEEEDAATYYCQHN RELPPTFGGGTKLEIK | 576 | RASKSVSTSGYSYL H | 696 | LASNLES | 816 | QHNRELPPT | 936 |

TABLE 2B-continued

The amino acid sequences of the light chain variable region (VL) and Chothia LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-504 | DVVMTQSPLTLSVTIGQPA SISCKSSQSLLYSNGKTYL NWLLQRPGQSPKRLIYLVS KLDSGVPDRFTGSGSGTDF TLKISRVEAEDLGVYYCVQ GTHFPHTFGGGTKLEIK | 577 | KSSQSLLYSNGKTY LN | 697 | LVSKLDS | 817 | VQGTHFPHT | 937 |
| VK-507 | DVVMTQTPLSLPVSLGDHA SISCRSSQSLIHSNGNNYL HWYLQKPGQSPKLLIYTVS NRFSGVPDRFSGSGSGTDF TLKISRVEAEDLGVYFCSQ STLVPLTFGSGTKLEIK | 578 | RSSQSLIHSNGNNY LH | 698 | TVSNRFS | 818 | SQSTLVPLT | 938 |
| VK-508 | DIVMTQSPSSLAMSVGQKV TMSCKSSQSLLNSSSQKNY LAWYQQKPGQSPKLLIYFA STRESGVPDRFIGSGSGTD FTLTISNVQAEDLADYFCQ QHYSTPPTFGGGTKLEIK | 579 | KSSQSLLNSSSQKN YLA | 699 | FASTRES | 819 | QQHYSTPPT | 939 |
| VK-510 | DVVMTQTPLSLPVSLGDHA SISCRSSQSLIHSNGNNYL HWYLQKPGQSPQLLIYKVS NRFSGVPDRFSGSGSGTDF TLKISRVEAEDLGVYFCSQ STLVPLTFGSGTKLELR | 580 | RSSQSLIHSNGNNY LH | 700 | KVSNRFS | 820 | SQSTLVPLT | 940 |
| VK-511 | DVVMTQTPLSLPVSLGDHA SISCRSSQSLVHSNGNIYL HWYLQRPGQSPKLLIHKVS NRFSGVPDRFSGSGSGTDF TLKISRVEAEDVGIYFCSQ STLVPLTFGSGTKLELK | 581 | RSSQSLVHSNGNIY LH | 701 | KVSNRFS | 821 | SQSTLVPLT | 941 |
| VK-518 | DVVMTQTPLSLPVSLGDHA SISCRSSQSLVHSNGNTYL HWYLQRPGQSPKLLIHKVS NRFSGVPDRFSGSGSGTDF TLKISRVEAEDVGIYFCSQ STLVPLTFGSGTKLELK | 582 | RSSQSLVHSNGNTY LH | 702 | KVSNRFS | 822 | SQSTLVPLT | 942 |
| VK-528 | DVVMTQTPLSLPVSLGDHA SISCRSSQSLIHSNGNNYL HWYLQKPGQSPKLLIYKVS NRFSGVPDRFSGSGSGTDF TLKISRVEAEDLGVYFCSQ STLVPLTFGSGTKLELK | 583 | RSSQSLIHSNGNNY LH | 703 | KVSNRFS | 823 | SQSTLVPLT | 943 |
| VK-521 | DVVMTQSPLSLPVSLGDHA SISCRSSQSLIHSNGNNYL HWYLQKPGQSPKLLIYTVS NRFSGVPDRFSGSGSGTDF TLKISRVEAEDLGVYFCSQ STLVPLTFGSGTKLEVK | 584 | RSSQSLIHSNGNNY LH | 704 | TVSNRFS | 824 | SQSTLVPLT | 944 |
| VK-530 | DVVMTQTPLSLPVSLGDHA SISCRSSQSLIHSNGNNYL HWYLQKPGQSPKLLIYTVS NRFSGVPDRFSGSGSGTDF TLKISRVEAEDLGVYFCSQ STLVPLTFGSGTKLEVK | 585 | RSSQSLIHSNGNNY LH | 705 | TVSNRFS | 825 | SQSTLVPLT | 945 |
| VK-541 | DIVMTQTPLSLPVSLGDQA SISCRSSQSLVHSSGNTYL HWYLQKPGQSPKLLIYKVS NRFSGVPDRFSGSGSGTDF TLRISRVAAEDLGVYFCSQ STLVPVTFGAGTELELK | 586 | RSSQSLVHSSGNTY LH | 706 | KVSNRFS | 826 | SQSTLVPVT | 946 |

TABLE 2B-continued

The amino acid sequences of the light chain variable region (VL) and Chothia LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-547 | DVVMTQTPLSLPVSLGNQA SISCRSSQRLVHSNGNTYL HWYLQKPGQSPKLLIYKVF NRFSGVPDRFSGSGSGTDF TLKISRVEAEDLGIYFCAQ STLVPPTFGGGTKLEIK | 587 | RSSQRLVHSNGNTY LH | 707 | KVFNRFS | 827 | AQSTLVPPT | 947 |
| VK-549 | DVVMTQTPLSLPVSLGDQA SISCRSSQSLVHSSENTYL HWYLQKPGQSPKLLIYKVS NRFSGVPDRFSGSGSGTDF TLKISRVEAEDLGVYFCSQ STLVPVTFGAGTKLELK | 588 | RSSQSLVHSSENTY LH | 708 | KVSNRFS | 828 | SQSTLVPVT | 948 |
| VK-550 | DVVMTQTPLSLPVSLGNQA SISCRSSQSLVHSNGNTYL HWYLQKPGQSPRLLIYKVF NRFSGVPDRFSGSGSGTDF TLKISRVEAEDLGVYFCAQ STLVPPTFGGGTKLEIK | 589 | RSSQSLVHSNGNTY LH | 709 | KVFNRFS | 829 | AQSTLVPPT | 949 |
| VK-553 | DVVMTQTPLSLPVSLGDQA SISCRSSQSLVHSSENTYL HWYVQKPGQSPKLLIYKVS NRFSGVPDRFSGSGSGTDF TLKISRVEAEDLGVYFCSQ STLVPVTFGAGTKLELK | 590 | RSSQSLVHSSENTY LH | 710 | KVSNRFS | 830 | SQSTLVPVT | 950 |
| VK-556 | DVVMTQTPLSLPVSLGNQA SISCRSSQSLVHSNGNTYL HWYLQKPGQSPRLLIYKVF NRFPGVPDRFSGSGSGTDF TLKISRVEAEDLGVYFCAQ STLVPPTFGGGTKLEIK | 591 | RSSQSLVHSNGNTY LH | 711 | KVFNRFP | 831 | AQSTLVPPT | 951 |
| VK-557 | DVVMTQTPLSLPVSLGDQA SISCRSSQSLVHSSGNTYL HWYLQKPGQSPKLLIYKVS NRFSGVPDRFSGSGSGTHF TLKLSRVEAEDLGIYFCSQ STLIPLTFGAGTKLEL | 592 | RSSQSLVHSSGNTY LH | 712 | KVSNRFS | 832 | SQSTLIPLT | 952 |
| VK-567 | DIQMTQSPSSLSASLGEKV SLTCRASQEISGYLSWLQQ KPDGSIKRLIYAASTLDSG VPKRFSGSRSGSVYSLTIS SLESEDFADYYCLHYANYP PTFGGGTKLEIR | 593 | RASQEISGYLS | 713 | AASTLDS | 833 | LHYANYPPT | 953 |
| VK-568 | DVQMTQSPSSLSASLGDTI TITCHASQNIYVWLNWFQQ KPGNIPKLLISKASDLHTG VPSRFSGSGSGTGFTLTIS SLQPEDIATYYCQQGLSYP LTFGGGTNLEIK | 594 | HASQNIYVWLN | 714 | KASDLHT | 834 | QQGLSYPLT | 954 |
| VK-583 | DVVMTQTPLSPPVSLGYQA SISCRSSQSLVHSNGNTYL NWYLQKPGQSPKLLIYKVS NRLSGVPDRFSGSGSGTDF TLKISRVETEDLGVYFCSQ STHVPYTFGGGTKLEIK | 595 | RSSQSLVHSNGNTY LN | 715 | KVSNRLS | 835 | SQSTHVPYT | 955 |
| VK-584 | DVVMTQTPLSLPVSLGDRA SISCRSGQSLVHSNGNTYL HWYLQRPGRSPNLLIYKVS NRFSGVPDRFSGSGSGTDF TLKISRVEAEDLGVYFCSQ STHVPWTFGGGTKLEIK | 596 | RSGQSLVHSNGNTY LH | 716 | KVSNRFS | 836 | SQSTHVPWT | 956 |

TABLE 2B-continued

The amino acid sequences of the light chain variable region (VL) and
Chothia LCDRs of the exemplary anti-C5aR1 antibodies

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-585 | DVVMTQTPLSLPVSLGDQA SISCRFSQSIVYSNGNTYL QWYLQKPGQSPKLLIYKVS NRFSGVPDRFSGSGSGTDF TLKISRVEAEDLGVYYCFQ GSHVPPTFGGGTKLEIK | 597 | RFSQSIVYSNGNTY LQ | 717 | KVSNRFS | 837 | FQGSHVPPT | 957 |
| VK-586 | DVVMTQTPLTLSVTIGQPT SISCKSSQSLLYSNGKTYL SWLLQRPGQSPKRLIYLVS KLDSGVPDRFTGSGSGTDF TLKINRVEAEDLGLYYCVQ NTHLPYTFGGGTKLEIR | 598 | KSSQSLLYSNGKTY LS | 718 | LVSKLDS | 838 | VQNTHLPYT | 958 |
| VK-588 | DIQMTQSTSSLSASLGDRV TISCRASQDISNYLNWYQQ TPDGTVKLLIYQISRLHSG VPSRFSGSGSGTDYSLTIS NLEEEDIANYFCQQGNSLP PTFGGGTKVEIK | 599 | RASQDISNYLN | 719 | QISRLHS | 839 | QQGNSLPPT | 959 |
| VK-592 | DIQMNQSPSSLSASLGDTI TITCHASQNIDVWLSWYQQ KPGNIPKLLIYKASNLHTG VPSRFSGRDSGTAFTLTIS SLQPEDIATYYCQQGHSYP LTFGSGTKLELK | 600 | HASQNIDVWLS | 720 | KASNLHT | 840 | QQGHSYPLT | 960 |

TABLE 3A

The amino acid sequences of the heavy chain variable region (VH) and
Kabat HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-11 | QVQLQQSGPELVKPGASVK ISCKASGYSFSSSWMNWVK QRPGKGLEWIGRISPGDGD TRYSGKFKGKATLTADKSS STAYMQVTSLTSEDSAIYF CVRRFLITSTRYVMDYWGQ GTTVTVSS | 961 | SSWMN | 1081 | RISPGDGDTRYSGKFKG | 1201 | RFLITSTRYVMDY | 1321 |
| VH-11v2 | QVQLQQSGPELVKPGASVK ISCKASGYSFSSSWMNWVK QRPGKGLEWIGRISPGDGD TRYSGKFKGKATLTADKSS STAYMQVTSLTSEDSAIYF CVRFLITSTRYVMDYWGQG TTVTVSS | 962 | SSWMN | 1082 | RISPGDGDTRYSGKFKG | 1202 | FLITSTRYVMDY | 1322 |
| VH-66 | QVQLQQSDAELVKPGASVK ISCKASGYTFIDHAIHWVK QRPEQGLEWIGYISPGNGE IKYNEKFKAKATLTADKSS SAAYMQLNSLTSADSAVYF CKRALFYYTGKYQPMDYWG QGTTVTDSS | 963 | DHAIH | 1083 | YISPGNGEIKYNEKFKA | 1203 | ALFYYTGKYQPMDY | 1323 |
| VH-79 | QVQLKESGPGLVAPSQSLS ITCTVSGFSLTSYAISWVR QPPGKGLEWLGVIWTGGGT KYNSALKSRLSISKDNSKS HVFLKMNSLQSDDTARYYC ARDGDYVYYAMAYWGQGTT VTVSS | 964 | SYAIS | 1084 | VIWTGGGTKYNSALKS | 1204 | DGDYVYYAMAY | 1324 |

TABLE 3A-continued

The amino acid sequences of the heavy chain variable region (VH) and Kabat HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-184 | QVQLQQSGAELVKPGASVKISCKASGYAFSRYWMNWVKQRPGKGLEWIGQIYPGDGDTKYNGKFKGKATLTADKSSSTAYMQLNSLTSEDSAVYFCTRSLGVWGTGTTVTVSS | 965 | RYWMN | 1085 | QIYPGDGDTKYNGKFKG | 1205 | SLGV | 1325 |
| VH-216 | QIQLVQSGPELKKPGETVKISCKASGYSFTTFGMSWVKQAPGKVLKWMGWINTYSGVPTYADDFKGRFAFSLETSASTAYLQINNLKNEDTATYFCARGLGRLLAYWGQGTLVTVSA | 966 | TFGMS | 1086 | WINTYSGVPTYADDFKG | 1206 | GLGRLLAY | 1326 |
| VH-272 | QVQLQQSGAELVKPGASVKISCKASGYAFSSYWMNWVKQRPGKGLEWIGHIYPGDGDTKYNGKFKGKATLTADKSSSTAYMQVSSLTSEDSAVYFCTRSLGVWGTGTTVTVSS | 967 | SYWMN | 1087 | HIYPGDGDTKYNGKFKG | 1207 | SLGV | 1327 |
| VH-308 | QVQLQQSGAELAKPGASVKMSCKASGYTFTSYWMHWVKQRPGQGLEWIGYINPSSGYTEYNQKFKDKATLTADKSSSTAYMQLSSLTSEDSAVYYCARGMFAMDYWGQGTTVTVSS | 968 | SYWMH | 1088 | YINPSSGYTEYNQKFKD | 1208 | GMFAMDY | 1328 |
| VH-317 | QVQLQQPGAELVMPGASVKLSCKASGYTFTSYWLHWVRQRPGQGLEWIGEIDPSDGYSNHNQKFKGKATLTVDKSSSTAYMQLSSLTSEDSAVYYCATEGFWGQGTTVTVSS | 969 | SYWLH | 1089 | EIDPSDGYSNHNQKFKG | 1209 | EGF | 1329 |
| VH-317v2 | QVQLQQPGAELVMPGASVKLSCKASGYTFTSYWMHWVKQRPGQGLEWIGEIDPSDSYTNYNQKFKGKATLTVDKSSSTAYMQLSSLTSEDSAVYYCARVAYYSNFGGFAYWGQGTTVTVSS | 970 | SYWMH | 1090 | EIDPSDSYTNYNQKFKG | 1210 | VAYYSNFGGFAY | 1330 |
| VH-322 | QVQLQQSDAALVKPGASVKISCKASGHTFTDHAIHWVKQRPEQGLEWIGYISPGNGDIKYNDKFKGKATLTADKSSSTAYMQLNSLTPEDSAVYFCKGPLFVRGQYYITMDYWGQGTTVTVSS | 971 | DHAIH | 1091 | YISPGNGDIKYNDKFKG | 1211 | PLFVRGQYYITMDY | 1331 |
| VH-329 | QVQLQQSGAELTKPGASVKLSCKASGYTFTNYWMHWVKQRPGQGLEWIGYLNPSSGYTKYNQKFKDKATLTADKSSSTAYMQLNSLTYEDSAVYCTRSGGDNYGNPYYFDRWGQGTTVTVSS | 972 | NYWMH | 1092 | YLNPSSGYTKYNQKFKD | 1212 | SGGDNYGNPYYFDR | 1332 |
| VH-330 | QVQLKQSGPGLVQPSQSLSIACTVSGFSLTSYGVHWVRQSPGKGLEWLGVIWRGGSTDYNAAFKSRLSITKDNSKSQVFFTMNRLHADDTAIYYCAKNSQLGNAMDYWGQGTTVTVSS | 973 | SYGVH | 1093 | VIWRGGSTDYNAAFKS | 1213 | NSQLGNAMDY | 1333 |

TABLE 3A-continued

The amino acid sequences of the heavy chain variable region (VH) and Kabat HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-332 | QVQLQQSDAELVKPGASVK ISCKASGYTFTDHSIHWVK QRPEQGLEWIGYISPGNGD IKYDEKFKGKATLTADTSS STAYMQLNSLTSEDSAVYF CKGPLLLRWRYFYPVDYWG QGTTVTVSS | 974 | DHSIH | 1094 | YISPGNGDIKYDEKFKG | 1214 | PLLLRWRYFYPVDY | 1334 |
| VH-335 | QVQLQQSDAALVKPGASVK ISCKASGYTFTDHAIHWVK QRPEQGLEWIGYISPGNGD IKYNEKFKGKATLTADKSS STAYMQLNSLTSEDSAVYF CKGPLLVRWRYYITMDYWG QGTTVTVSS | 975 | DHAIH | 1095 | YISPGNGDIKYNEKFKG | 1215 | PLLVRWRYYITMDY | 1335 |
| VH-336v1 | EVKLEESGGGLVQPGGSMK LSCAASGFTFSDAWMDWVR QSPEKGLEWVAEIRNKANN HATYYAESVKGRFTISRDD SKSSVYLQMNSLRAEDTGI YYCTRGGYYVFAYWGQGTT VTVSS | 976 | DAWMD | 1096 | EIRNKANNHATYYAESVKG | 1216 | GGYYVFAY | 1336 |
| VH-336v2 | QVQLKQSGPGLVQSSQSLS ITCTVSGFSLISYGVHWVR QSPGKGLEWLGVIWSGGST DYNAAFKSRLSITKDNSKS QVFFKMNSLQADDTAIYYC AKNSQLGNAMDYWGQGTTV TVSS | 977 | SYGVH | 1097 | VIWSGGSTDYNAAFKS | 1217 | NSQLGNAMDY | 1337 |
| VH-336v3 | QVQLQQPGAELVKPGASVK LSCKASGYTFTSYWMHWVK QRPGQGLEWIGMIHPNSNS TNYNEKFKSKATLTVDKSS STAYMQLSSLTSEDSAVYY CARSLTGTKTYWGQGTTVT VSS | 978 | SYWMH | 1098 | MIHPNSNSTNYNEKFKS | 1218 | SLTGTKTY | 1338 |
| VH-338 | EVQLQQSGPELVKPGASVK MSCKASGYTFTDYNMHWVK QSHGKSLEWIGYINPNNGG TSYNQKFKGKATLTVNKSS STAYMELRSLTSEDSAVYY CAHGEGDYAYWGQGTTVTV SS | 979 | DYNMH | 1099 | YINPNNGGTSYNQKFKG | 1219 | GEGDYAY | 1339 |
| VH-341v1 | EFQLQQSGPELVKPGASVK MSCKASGYTFTKYVIHWVK QKPGQGLEWIGYINPYNDG TKYNEKFKGKARLTSDKSS NTVYMDLSSLTSEDSAVYY CATARATSYWGQGTTVTVS S | 980 | KYVIH | 1100 | YINPYNDGTKYNEKFKG | 1220 | ARATSY | 1340 |
| VH-341v2 | QVQLQQPGAEFVKPGASVK MSCKASGYSFTSYWITWLK QRPGQGLEWIGDIYPGRGT TDYNEKLKSRATLTVDTSS TTAYMQLSSLTSEDSAVYY CARWGTTGRSYWGQGTTVT VSS | 981 | SYWIT | 1101 | DIYPGRGTTDYNEKLKS | 1221 | WGTTGRSY | 1341 |
| VH-343 | QVQLQQSGAELVKPGASVK LSCKASGYTFTEYTIHWVN QRSGQGLEWIGWFYPGSGS IKYNEKFKDKATLTADKSS HTVYMELSRLTSEDSAVYF CARHGNYYDGSWFAYWGQG TLVTVSA | 982 | EYTIH | 1102 | WFYPGSGSIKYNEKFKD | 1222 | HGNYYDGSWFAY | 1342 |

TABLE 3A-continued

The amino acid sequences of the heavy chain variable region (VH) and Kabat HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-399 | EVQLVESGGDLVKPGGSLKLSCAASGFTFSNYGMSWVRQTPDKRLEWVATITSGGTHTYYPDSVKGRFTISRDNAKNTLYLQMSSLKSEDTAMYYCTRHGAYYSNPWFAYWGQGTLVTVS | 983 | NYGMS | 1103 | TITSGGTHTYYPDSVKG | 1223 | HGAYYSNPWFAY | 1343 |
| VH-402 | QIQLVQSGPELKKPGETVKISCKASGYTFTTFGMSWVKQAPGKGLKWMGWINTNSGMPTYTDDFRGRFAFSLETSASTAYLQISSLKNEDTATYFCARKSLFYWGQGTTLTVSS | 984 | TFGMS | 1104 | WINTNSGMPTYTDDFRG | 1224 | KSLFY | 1344 |
| VH-416 | QVQLQQSGAELAKPGASVKLSCKASGYTFISYWMHWVKQRPGQGLEWIGYINPRSDYAKYNQKFKDKATLTTNKSSSTAYMQLSSLTYEDYAVYYCARVTGTEGPYYFDYWGQGTTLTVSS | 985 | SYWMH | 1105 | YINPRSDYAKYNQKFKD | 1225 | VTGTEGPYYFDY | 1345 |
| VH-429 | QVQLQQSGAELAKPGASVKLSCKASGYTFSSYWIHWVKQRPGQGLEWIGYINPRGDYTKYNQKFKDKATLTADKSSSTAFMQLSSLTYEDSAVYYCVRVTGSEGPYYFDYWGQGTTLTVSS | 986 | SYWIH | 1106 | YINPRGDYTKYNQKFKD | 1226 | VTGSEGPYYFDY | 1346 |
| VH-430 | QVQLQQSGADLAKPGASVKLSCKASGYTFTSYWIHWVKQRPGQGLEWIGYINPRGDYTKYNQKFKDKATLTADRSSSTAYMQLSSLTYEDYAVYYCARVTGTEGPYYFDYWGQGTTLTVSS | 987 | SYWIH | 1107 | YINPRGDYTKYNQKFKD | 1227 | VTGTEGPYYFDY | 1347 |
| VH-440 | QIQLVQSGPELKKPGETVKISCKASGYTFTAYGMSWVKQTPGKGLKWMGWINTYSGVPANADDFKGRFAFSLETSASTAYLQINNLKNEDTATYFCARSRYDGYFDYWGQGTTLTVSS | 988 | AYGMS | 1108 | WINTYSGVPANADDFKG | 1228 | SRYDGYFDY | 1348 |
| VH-453 | QVQLKQSGPGQVAPSQSLSITCTVSGFSLINSAVHWVRQSPGKGLEWLGVIWSDGSTDYNTAFISRLSISRDNSKSQVFFKMRSLQVDDTAVYYCARNGRLGNAMDYWGQGTSVTVSS | 989 | NSAVH | 1109 | VIWSDGSTDYNTAFIS | 1229 | NGRLGNAMDY | 1349 |
| VH-454 | QVQLKQSGPGLVAPSQSLSITCTVSGFSLTSYGVDWIRQSPGKGLEWLGVIWGVGSTNYNSALKSRLSISKDNSRSQVFLKLNSLQTDDTAMYYCASPYYSHYVPFAYWGQGTLVTVSA | 990 | SYGVD | 1110 | VIWGVGSTNYNSALKS | 1230 | PYYSHYVPFAY | 1350 |
| VH-465 | QVQLQQSGAELAKPGASVKLSCKASGYIFTSYWMNWVKQRPGQGLEWIGYINPSTTSTKYNQKFKDKATLTADKSSTTAYMQLTSLTYEDSAVYYCARPDNSGYVGFAYWGQGTLVTVSA | 991 | SYWMN | 1111 | YINPSTTSTKYNQKFKD | 1231 | PDNSGYVGFAY | 1351 |

TABLE 3A-continued

The amino acid sequences of the heavy chain variable region (VH) and Kabat HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-475 | QVQLKQSGPGLVAPSQSLSITCTVSGFSLTSYGVDWIRQSPGKGLEWLGVIWGVGGTNYNSALKSRLSISKDNSRSQVFLKLNSLQTDDTAMYYCASPYYSHVPFAYWGQGTLVTVSA | 992 | SYGVD | 1112 | VIWGVGGTNYNSALKS | 1232 | PYYSHYVPFAY | 1352 |
| VH-481 | QVQLQQSGAELAKPGASVQVSCKASGYSFTRYWMHWIKQRPGQGLEWIGYINPSTDYSAYNQKFKDKATLTADKSSSTAYLQLTSLTSEDSAVYYCAGGLPHFDYWGQGTTLTVSS | 993 | RYWMH | 1113 | YINPSTDYSAYNQKFKD | 1233 | GLPHFDY | 1353 |
| VH-497 | QVQLKQSGPGLVAPSQSLSITCTVSGFSLTTYGVHWVRQPPGKGLEWLVVIWSDGSTTYNSALKSRLSISKDNSKSQVFLKMNSLQPDDTAMYYCARNSRYGNSFAYWGQGTLVTVSA | 994 | TYGVH | 1114 | VIWSDGSTTYNSALKS | 1234 | NSRYGNSFAY | 1354 |
| VH-502 | DVQLQESGPDLVKPSQSLSLTCTVTGYSITSGYSWHWIRQFPGNKLEWMGYIHYSGSTNYNPSLKSRISITRDTSKNQFFLQLKSVTTEDTATYYCVFWLPFDYWGQGTTLTVSS | 995 | SGYSWH | 1115 | YIHYSGSTNYNPSLKS | 1235 | WLPFDY | 1355 |
| VH-503 | DVQLQESGPGLVKPFQSLSLTCTVTGYSITSDYAWNWIRQFPGNKLEWMGYINYSGSTSYNPSLRSRISITRDTSKNQFFLHLNSVTTEDTATYYCARMGYRYPWFAYWGQGTLVTVSA | 996 | SDYAWN | 1116 | YINYSGSTSYNPSLRS | 1236 | MGYRYPWFAY | 1356 |
| VH-504 | EVQLKQSGGGLVKPGGSLKLSCAASGFTFSSYTMSWVRQTPEKRLEWVATISSGGSYTYYPDSVKGRFTISRDNAKNTLYLQMSSLKSEDTAMYYCTRGGGNYDAMDYWGQGTSVTVSS | 997 | SYTMS | 1117 | TISSGGSYTYYPDSVKG | 1237 | GGGNYDAMDY | 1357 |
| VH-507 | QVQLQQSGAELAKPGASVKLSCKASGYTFTNYWMHWVKQRPGQGLEWIGYINPSSASSKYNQKFKDRATLTTDKSSSTAFMHLSSLTYEDSAVYYCARVPLPYGSSYGPYFFDFWGQGTTLTVSS | 998 | NYWMH | 1118 | YINPSSASSKYNQKFKD | 1238 | VPLPYGSSYGPYFFDF | 1358 |
| VH-508 | QVQLQQSGAELARPGASVKMSCKASGYTFTSYTMHWVKQRPGQGLEWIGYINPSSGYTKYNQKFKDKATLTADKSSSTAYMQLSSLTSEDSAVYYCARSGDYDGFAYWGQGTLVTVSA | 999 | SYTMH | 1119 | YINPSSGYTKYNQKFKD | 1239 | SGDYDGFAY | 1359 |
| VH-510 | QVQLQQSGAELAKPGASVKLSCKASGYTFTSYWMHWVKQRPGQGLEWIGYINPSSGYTKYNQKFKDRATLTADKSSSTAYMQLSSLTYEDSAVYYCARVPLSYGSSYGPYFFDYWGQGTTLTVSS | 1000 | SYWMH | 1120 | YINPSSGYTKYNQKFKD | 1240 | VPLSYGSSYGPYFFDY | 1360 |

TABLE 3A-continued

The amino acid sequences of the heavy chain variable region (VH) and Kabat HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-511 | QVQLQQSGAELAKPGASVK LSCKTSGYTFTNYWMHWIK QRPGLGLEWIGYINPSGDY TKHNQKFKDKATLTADRSS STAYMQLSSLTYEDSAVYY CARVPLSYGSGNGPYYFDY WGQGTTLTVSS | 1001 | NYWMH | 1121 | YINPSGDYTKHNQKFKD | 1241 | VPLSYGSGNGPYY FDY | 1361 |
| VH-521 | QVQLQQSRAALAKPGASVK LSCKASGYTFTNHWMHWVK QRPGQGLEWIGYINPINGF NRYNQNFKDRATLTTDKAS STAFIHLNGLTYEDFAVYY CARVPLSYGGSYGPYFFDF WGQGTILTVSS | 1002 | NHWMH | 1122 | YINPINGFNRYNQNFKD | 1242 | VPLSYGGSYGPYF FDF | 1362 |
| VH-530 | QVQLQQSRAALAKPGASVK LSCKASGYTFTNHWLHWVK QRPGQGLEWIGYINPINGF SKYNQNFKNRATLTTDSSS STAFIHLSGLTYEDFAVYY CARVPLSYGGSYGPYFFDF WGQGTILTVSS | 1003 | NHWLH | 1123 | YINPINGFSKYNQNFKN | 1243 | VPLSYGGSYGPYF FDF | 1363 |
| VH-536 | QVQLQQSGAALAKPGASVK LSCKASGYSFTNYWMHWVK QRPGQGLEWIGYINPINGY GKYNQNFKDRATLTTDKSS STAFIHLSGLTYEDSAVYY CARVPLSYGGSYGPYFFDF WGQGTILTVSS | 1004 | NYWMH | 1124 | YINPINGYGKYNQNFKD | 1244 | VPLSYGGSYGPYF FDF | 1364 |
| VH-541 | QVQLQQSGPELVKPGESVK MSCKASGYTFTDYYMDWVK QSHGKSLEWIGYFYPNNGG VKYSQKFKDKAALTVDKSS TTAYMELHSLTFEDSAVYY CTRGSGPFAYWGQGTLVTV SA | 1005 | DYYMD | 1125 | YFYPNNGGVKYSQKFKD | 1245 | GSGPFAY | 1365 |
| VH-547 | QVQLKQSGPGLVAPSQSLS ITCTVSGFSLTNYGVDWVR QSPGKGLEWLGVIWGDGIT KYNSALKSRLSISKDNSKS QVFLKMNSLQTDDTAMYYC ASALDYSNYGFAYWGQGTL VTVSA | 1006 | NYGVD | 1126 | VIWGDGITKYNSALKS | 1246 | ALDYSNYGFAY | 1366 |
| VH-549 | QVQLQQSGPELVKPGDSVK MSCKVSGYTFTDYYIDWVK QSHGKSLEWIGYFYPNNGG AKYNQKFKSKAALTVDKSS TTAYMELHSLTFEDSAVYY CTRGSGPFAYWGQGTLVTV SA | 1007 | DYYID | 1127 | YFYPNNGGAKYNQKFKS | 1247 | GSGPFAY | 1367 |
| VH-550 | QVQLKQSGPGLVAPSQSLS ITCTVSGFSLTNCGVDWVR QSPGKSLEWLGVIWGDGLT KYNSALKSRLSISKDNSKS QVFLKVNSLQTDDTAVYYC ASALDYSNYGFAYWGQGTL VTVSA | 1008 | NCGVD | 1128 | VIWGDGLTKYNSALKS | 1248 | ALDYSNYGFAY | 1368 |
| VH-553 | QVQLQQSGPELVKPGDSVK MSCKASGYTFTDYYMDWVK QSHGKSLEWIGYFYPNNGG AKYNQKFKGKAALTVDKSS TTAYMELHSLTFEDSAVYY CTRGSGPFAYWGQGTLVTV SA | 1009 | DYYMD | 1129 | YFYPNNGGAKYNQKFKG | 1249 | GSGPFAY | 1369 |

TABLE 3A-continued

The amino acid sequences of the heavy chain variable region (VH) and Kabat HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-556 | QVQLKQSGPGLVAPSQSLSITCTVSGFSLTNCGVDWVRQSPGKSLEWLGVIWGDGLTKYNSALKSRLSISKDNSKSQVFLKVNRLQTDDTAMYYCASALDYSNFGFAYWGQGTLVTVSA | 1010 | NCGVD | 1130 | VIWGDGLTKYNSALKS | 1250 | ALDYSNFGFAY | 1370 |
| VH-557 | QVQLQQSGPELVKPGDSVKMSCKASGYTFSDYYMDWVKQSHGKSLEWIGYFYPNNDGIRYNQRFKGRASLTVDKSSNTAYMELHSLTSEDSAVYYCARGSGPFVYWGQGTLVTVSA | 1011 | DYYMD | 1131 | YFYPNNDGIRYNQRFKG | 1251 | GSGPFVY | 1371 |
| VH-567 | DVQLQESGPGLVKPSQSLSLTCTVTGYSITSDSAWNWIRQFPGNKLEWMGYISYSGRISYNPSLKSRISITRDTSKNQFFLQFNSVTTEDTAKYYCARASIGFDYWGQGTTLTVSS | 1012 | SDSAWN | 1132 | YISYSGRISYNPSLKS | 1252 | ASIGFDY | 1372 |
| VH-568 | EVQLQQSGADLVKPGASVKLSCTVSGFNIKDSYIHWLKQRPGQGLEWIGRIDPTNVNTKYDPKFQGKASITTDTSSNTAYLQLSSLTSENTAVYYCARRLRQTYAMDYWGQGTSVTVSS | 1013 | DSYIH | 1133 | RIDPTNVNTKYDPKFQG | 1253 | RLRQTYAMDY | 1373 |
| VH-570 | DVQLQESGPGLVKPSQSLSLTCTVTGYSITSDSAWNWIRQFPGNKLEWMGYISYSGRISYNPSLKSRISITRDTSKNQIFLQFNSVTTEDTAKYYCARASIGFDYWGQGTTLTVSS | 1014 | SDSAWN | 1134 | YISYSGRISYNPSLKS | 1254 | ASIGFDY | 1374 |
| VH-573 | DVQLQESGPGLVKPSQSLSLTCTVTGYSITSDSAWNWIRQFPGNKLEWMGYISYSGRISYNPSLKSRISITRDTSKNQFFLQFYSVTTEDTARYYCARASIGFDYWGQGTTLTVSS | 1015 | SDSAWN | 1135 | YISYSGRISYNPSLKS | 1255 | ASIGFDY | 1375 |
| VH-583 | EVQLVESGGGLVKPGGSLKLSCAASGFTFNAYAMSWVRQTPEKRLEWVASISTGGNTYCPDSVKDRFTVSRDNVRNILYLQMSSLRSEDTAMYYCTRGYQRFSGFAYWGQGTLVTVS | 1016 | AYAMS | 1136 | SISTGGNTYCPDSVKD | 1256 | GYQRFSGFAY | 1376 |
| VH-584 | DVQLQESGPDLVKPSQSLSLTCTVTGYSITSGYSWHWIRQSPGNKLEWLAYIHNSGSTNYNPSLKSRISITRDTSKNQFFLKLNSVTTEDTATYYCARSIGDYWGQGTTLAVSS | 1017 | SGYSWH | 1137 | YIHNSGSTNYNPSLKS | 1257 | SIGDY | 1377 |
| VH-585 | DVQLQESGPGLVKPSQSLSLTCTVTGYSITSDYAWNWIRQFPGNKLEWMGYISYSGSTSYNPSLKSRISITRDTSKNQFFLQLSSVTTEDTATYYCARYGGNYPTYAMDYWGQGTSVTVSS | 1018 | SDYAWN | 1138 | YISYSGSTSYNPSLKS | 1258 | YGGNYPTYAMDY | 1378 |

TABLE 3A-continued

The amino acid sequences of the heavy chain variable region (VH) and Kabat HCDRs of the exemplary anti-C5aR1 antibodies

| Name | VH sequence | SEQ ID NO: | HCDR1 | SEQ ID NO: | HCDR2 | SEQ ID NO: | HCDR3 | SEQ ID NO: |
|---|---|---|---|---|---|---|---|---|
| VH-586 | DVQLQESGPDLVKPSQSLSLTCIVAGFSLTDSYSWHWIRQFPGNKLEWMGYIHYSGRTNYNPSLKTQFSITRNTSKNQFFLQLISVPTEDTATYYCARYDFAYWGRGTSVTVSS | 1019 | DSYSWH | 1139 | YIHYSGRTNYNPSLKT | 1259 | YDFAY | 1379 |
| VH-588 | DVQLQESGPGLVKPSQSLSLTCTVTGYSITSDYAWNWIRQFPGNKLEWMGYISYSGSIRYNPSLKSRISITRDTSKNQFFLQLNSVTTEDTATYYCAITTGGYFDYWGQGTTLTVSS | 1020 | SDYAWN | 1140 | YISYSGSIRYNPSLKS | 1260 | TTGGYFDY | 1380 |
| VH-592 | QVQLKQSGAELVRPGSSVGISCKASGYAFTNFWMNWVRQRPGQGLEWIGQLYPGDDDTHYNGKFKGKVTLTADRSSGTAYMQLSRLTSEDSAVYFCAVTEVKRRRSFAYWGQGTLVTVSA | 1021 | NFWMN | 1141 | QLYPGDDDTHYNGKFKG | 1261 | TEVKRRRSFAY | 1381 |

TABLE 3B

The amino acid sequences of the light chain variable region (VL) and Kabat LCDRs of the exemplary anti-C5aR1 antibodies are provided as follows.

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-11 | DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTLVPPTFGGGTKLEIK | 1022 | RSSQSLVHSNGNTYLH | 1142 | KVSNRFS | 1262 | SQSTLVPPT | 1382 |
| VK-66 | DIVMTQSQKFMSTTAGDRVSITCKASQNVGSAVVWYQQKPGRSPKLLIYSSSIRYTGVPDRFTGSGSGTDFTLTINSVQSEDLADYFCQQYNSFPLTFGAGTKLEIK | 1023 | KASQNVGSAVV | 1143 | SSSIRYT | 1263 | QQYNSFPLT | 1383 |
| VK-79 | DVVMTQTPLSLPVSLGDQASISCRSSQSLVHSNGNTYLHWYLQKPGQSPKLLIYKVSNRFSGVPDRFSGSGSGTDFKLKISRVEAEDLGVYFCSQSTHVPPTFGGGTKLEIK | 1024 | RSSQSLVHSNGNTYLH | 1144 | KVSNRFS | 1264 | SQSTHVPPT | 1384 |
| VK-184 | DVVMTQTPLTLSVTIGQPASISCKSSQSLLHSNGKTYLNWLLQRPGQSPKRLIYLVSKLDSGVPDRFTGSGSGTDFTLKISRVEAEDLGVYCCVQGTHVPYTFGGGTKLEIK | 1025 | KSSQSLLHSNGKTYLN | 1145 | LVSKLDS | 1265 | VQGTHVPYT | 1385 |
| VK-184_C_Y | DVVMTQTPLTLSVTIGQPASISCKSSQSLLHSNGKTYLNWLLQRPGQSPKRLIYLVSKLDSGVPDRFTGSGSGTDFTLKISRVEAEDLGVYYCVQGTHVPYTFGGGTKLEIK | 1026 | KSSQSLLHSNGKTYLN | 1146 | LVSKLDS | 1266 | VQGTHVPYT | 1386 |

TABLE 3B-continued

The amino acid sequences of the light chain variable region (VL) and Kabat LCDRs of the exemplary anti-C5aR1 antibodies are provided as follows.

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-216_272 | DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCLQATHFPWTFGGGTKLEIK | 1027 | KSSQSLLDSDGKTYLN | 1147 | LVSKLDS | 1267 | LQATHFPWT | 1387 |
| VK-308 | DIVMTQSQNFMSTSVGDRVSVTCKASQYVGTYVAWYQQKPGQSPKALIYSASYRHTGVPDRFTGSGSGTDFTLTISNVQSEDLADYFCQQYSSSPYTFGGGTKLEIK | 1028 | KASQYVGTYVA | 1148 | SASYRHT | 1268 | QQYSSSPYT | 1388 |
| VK-317 | DIVMTQSPSSLSVSAGEKVTMSCKSSQSLLKSGNQKNYLAWHQQKPGQPPKLLIYGASTRESGVPDRFTGSGSGTDFTLTISSVQAEDLAVYYCQNDHSHPYTFGGGTKLEIK | 1029 | KSSQSLLKSGNQKNYLA | 1149 | GASTRES | 1269 | QNDHSHPYT | 1389 |
| VK-317v2 | DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLYTFGGGTKLEIK | 1030 | KSSQSLLNSRTRKNYLA | 1150 | WASTRES | 1270 | KQSYNLYT | 1390 |
| VK-322 | DIVMTQSQKFMSTTVGDRVSITCKASQNVGAAVVWYQQKPGQSPKLLIYSASYRYSGVPDRFTGSGSGTDFTLTISNMQSEDLADYFCQQYNSFPLTFGGGTKLEIK | 1031 | KASQNVGAAVV | 1151 | SASYRYS | 1271 | QQYNSFPLT | 1391 |
| VK-329 | DVVMTQTPLSLTVSLGDQASISCRSSQSLVHSNGNTYLHWYLQKPGQSPKFLIYKVSNRFSGVPDRFSGSGSGTDFRLKISRVEAEDLGVYFCSQSTLVPLTFGAGTKLEIK | 1032 | RSSQSLVHSNGNTYLH | 1152 | KVSNRFS | 1272 | SQSTLVPLT | 1392 |
| VK-330 | DIVMSQSPSSLAVSVGEKVTMSCKSSQSLFNSRTRKNYLAWYQQKPGQSPKLLIYWASTRESGVPDRFTGSGSGTDFTLTINSVQAEDLALYYCNQSYDLLTFGAGTKLEIK | 1033 | KSSQSLFNSRTRKNYLA | 1153 | WASTRES | 1273 | NQSYDLLT | 1393 |
| VK-332 | DIVMTQSQKFMSSAVGDRVTITCKASQNVGAAVAWYQQKPGQSPKLLLYSASIRYTGVPDRFTGSGSGTDFTLTISNIQSEDLAHFFCQQYNSFPLTFGGGTKLEIK | 1034 | KASQNVGAAVA | 1154 | SASIRYT | 1274 | QQYNSFPLT | 1394 |
| VK-335 | DIVMTQSQKFMSTTVGDRVSITCKASQNVGAAVVWYQQKPGQSPKLLIYSASYRYTGVPDRFTGSGSGTDFTLTISNMQSEDVADYFCQQYNSFPLTFGGGTKLEIK | 1035 | KASQNVGAAVV | 1155 | SASYRYT | 1275 | QQYNSFPLT | 1395 |
| VK-336v1 | DIVMSQSPSSLAVSAGEKVTMSCKSSQSLLSSRTRKNYLAWYQQKPGQSPKLLIYWASTRESGVPDRFTGSGSGTDFTLTISSVQAEDLALYFCNQSYDLLTFGAGTKLEIK | 1036 | KSSQSLLSSRTRKNYLA | 1156 | WASTRES | 1276 | NQSYDLLT | 1396 |

TABLE 3B-continued

The amino acid sequences of the light chain variable region (VL) and Kabat LCDRs of the exemplary anti-C5aR1 antibodies are provided as follows.

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-336v2 | DIVMTQSPATLSVTPGDRVSLSCRASQSISDYLHWYQQKSHESPRLLIKYASQSISGIPSRFSGSGSGSDFTLSINSVEPEDVGVYYCQNGHSFPPTFGAGTKLEIK | 1037 | RASQSISDYLH | 1157 | YASQSIS | 1277 | QNGHSFPPT | 1397 |
| VK-338v1 | DIVMTQSQKFMSTTLGDRVSIPCKASQSVGAAVAWYQQKPGQSPKLLIYSASIRYAGVPDRFTGSGSGTDFTLTVSNMRSEDLADYFCQQYNSFPLTFGGGTKLEIK | 1038 | KASQSVGAAVA | 1158 | SASIRYA | 1278 | QQYNSFPLT | 1398 |
| VK-338v2 | DIQMTQSSSYLSVSLGGRVTITCKASDHINNWLAWYQQKPGNAPRLLISGATSLETGVPSRFSGSGSGKDYTLSITSLQTEDVATYYCQQYWSTPYTFGGGTKLEIK | 1039 | KASDHINNWLA | 1159 | GATSLET | 1279 | QQYWSTPYT | 1399 |
| VK-341v1 | DVVMTQTPLTLSVTIGQPVSISCKSSQSLLESDGKTYLNWLLQRPGESPKLLIYLVSKLDSGVPDRFTGSGSGTDFTLKISRVEAEDLGVFYCLQATHFPHTFGGGTKLEIK | 1040 | KSSQSLLESDGKTYLN | 1160 | LVSKLDS | 1280 | LQATHFPHT | 1400 |
| VK-341v2 | DIQMTQSPSSLSASLGERVSLTCRASQEIKTYLSWLQQKPDGTIKRLIYAATTLESVVPKRFSGSWSGSEYSLTISSLESEDFADYYCLQYASYPWTFGGGTKLEIK | 1041 | RASQEIKTYLS | 1161 | AATTLES | 1281 | LQYASYPWT | 1401 |
| VK-343 | DVQITQSPSYLAASPGETITINCRASKSISKYLAWYQEKPGKTNKLLIYSGSTLQSGIPSRFSGSGSGTDFTLTISSLEPEDFAMYYCQQHDEYPWTFGGGTKLEIK | 1042 | RASKSISKYLA | 1162 | SGSTLQS | 1282 | QQHDEYPWT | 1402 |
| VK-399 | DIVMTQSQKFMSTSVGDRVSVTCKASQNVGENVSWYQQKPGQFPKALIYSASYRYSGVPDRFTGSGSGTDFSLTISNVQSEDLAEYFCQQYNSSPWTFGGGTKLEIK | 1043 | KASQNVGENVS | 1163 | SASYRYS | 1283 | QQYNSSPWT | 1403 |
| VK-402 | DVVMTQSPLTLSVTIGQPASISCRSSRSLLDSDGKTKLHWLLQRPGQSPKSLIYLVSKLDSGVPNRFTGGGSGTDFTLKINRVEAEDLGVYYCWQGTHFPWTFGVGTKLEIK | 1044 | RSSRSLLDSDGKTKLH | 1164 | LVSKLDS | 1284 | WQGTHFPWT | 1404 |
| VK-416 | DVVMTQTPLSLPVSLGGQASISCRSSQSLVHSNGNTYLHWYLQKPGQSPKFLIYKVSNRISGVPDRFSGSGSGTDFTLKISRVEAEDLGVYFCSQSTLVPLTFGAGTKLELR | 1045 | RSSQSLVHSNGNTYLH | 1165 | KVSNRIS | 1285 | SQSTLVPLT | 1405 |
| VK-429 | DVVMTQTPLSLPVSLGDQASISCRSSQSLVHSNGNTYLQWYLQKPGQSPKLLIYKVSNRFSGVPDRFSGSGSGTEFTLKIRRVEAEDLGVFLCSQSTLVPLTFGAGTKLELK | 1046 | RSSQSLVHSNGNTYLQ | 1166 | KVSNRFS | 1286 | SQSTLVPLT | 1406 |

TABLE 3B-continued

The amino acid sequences of the light chain variable region (VL) and Kabat LCDRs of the exemplary anti-C5aR1 antibodies are provided as follows.

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-430 | DVVMTQTPLSLPVSLGDQVSISCRSSQSLVHSNGNTYLQWYLQKPGQSPKLLIYKVSNRFSGVPDRFSGSGSGTDFTLKISRVEAEDLGVYFCSQSTLVPLTFGAGTKLELR | 1047 | RSSQSLVHSNGNTYLQ | 1167 | KVSNRFS | 1287 | SQSTLVPLT | 1407 |
| VK-440 | ENVLTQSPAIMSASPGEKVTITCSASSSVSYMHWFQQKPGTSPKLWIYSTSNLASGVPTRFSGSGSGTSYSLTISRMEAEDAATYYCQQRSSYPPTFGGGAKLEIK | 1048 | SASSSVSYMH | 1168 | STSNLAS | 1288 | QQRSSYPPT | 1408 |
| VK-453 | DIVMTQSPSSLAVSVGEKVTMSCKSSQSLFSSRTRKNYLAWYQQKPGQSPKLLIYWASTRESGVPYRFTGSGSGTDFTLTISSVQTEDLAVYYCKQSYNLLTFGAGTKLEL | 1049 | KSSQSLFSSRTRKNYLA | 1169 | WASTRES | 1289 | KQSYNLLT | 1409 |
| VK-454 | DVVMTQTPLSLPVSLGDQASISCRSSQSLVHSNGNTYLHWYLQKPGQSPKLLIYRVSNRFSGVPDRFSGSGSGTDFTLKISRVEAEDLGVYFCSQSTHVPPTFGGGTKLEIK | 1050 | RSSQSLVHSNGNTYLH | 1170 | RVSNRFS | 1290 | SQSTHVPPT | 1410 |
| VK-465 | DVVMTQTPLSLPVSLGDQASVSCRSSQSLVHSTGNTFLHWYLQKPGQSPKLLIYKVSNRFSGVPDRFSGSGSGTDFTLKISRVEAEDLGVYFCSQSTLVPLTFGAGTKLELK | 1051 | RSSQSLVHSTGNTFLH | 1171 | KVSNRFS | 1291 | SQSTLVPLT | 1411 |
| VK-475 | DVVMTQTPLSLPVSLGDQASISCRSSQSLVHSNGNTYLHWYLQKPGQSPKLLIYKVSNRFSGLPDRFSGSGSGTDFTLKISRVEAEDLGVYFCSQSTLVPPTFGGGTKLEIK | 1052 | RSSQSLVHSNGNTYLH | 1172 | KVSNRFS | 1292 | SQSTLVPPT | 1412 |
| VK-481 | DVVMTQTPLSLPVSLGDQASISCRSSQSLVHNNGVTYLHWYLQKPGQSPKLLIYKVSNRFSGVPDRFSGSGSGTDFTLKISRVEAEDLGVYFCSQSTHVPITFGAGTKLELK | 1053 | RSSQSLVHNNGVTYLH | 1173 | KVSNRFS | 1293 | SQSTHVPIT | 1413 |
| VK-497 | DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPFTFGSGTKLEIK | 1054 | RSSQSLVHSNGNTYLH | 1174 | KVSNRFS | 1294 | SQSTHVPFT | 1414 |
| VK-502 | DVVMTQTPLSLPVSLGDQASISCRSSQSLVHSNGNTYLHWYLQKSGQSPKLLIYKVSNRFSGVPDRFSGSGSGTDFTLKISRVEAEDLGVYFCSQSTHVPYTFGGGTKLEIK | 1055 | RSSQSLVHSNGNTYLH | 1175 | KVSNRFS | 1295 | SQSTHVPYT | 1415 |
| VK-503 | DIVLTQSPASLAVSLGQRATISCRASKSVSTSGYSYLHWYQQKPGQPPKLLIYLASNLESGVPARFSGSGSGTDFTLNIHPVEEEDAATYYCQHNRELPPTFGGGTKLEIK | 1056 | RASKSVSTSGYSYLH | 1176 | LASNLES | 1296 | QHNRELPPT | 1416 |

TABLE 3B-continued

The amino acid sequences of the light chain variable region (VL) and Kabat LCDRs of the exemplary anti-C5aR1 antibodies are provided as follows.

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-504 | DVVMTQSPLTLSVTIGQPASI SCKSSQSLLYSNGKTYLNWLL QRPGQSPKRLIYLVSKLDSGV PDRFTGSGSGTDFTLKISRVE AEDLGVYYCVQGTHFPHTFGG GTKLEIK | 1057 | KSSQSLLYSNGKTYLN | 1177 | LVSKLDS | 1297 | VQGTHFPHT | 1417 |
| VK-507 | DVVMTQTPLSLPVSLGDHASI SCRSSQSLIHSNGNNYLHWYL QKPGQSPKLLIYTVSNRFSGV PDRFSGSGSGTDFTLKISRVE AEDLGVYFCSQSTLVPLTFGS GTKLEIK | 1058 | RSSQSLIHSNGNNYLH | 1178 | TVSNRFS | 1298 | SQSTLVPLT | 1418 |
| VK-508 | DIVMTQSPSSLAMSVGQKVTM SCKSSQSLLNSSSQKNYLAWY QQKPGQSPKLLIYFASTRESG VPDRFIGSGSGTDFTLTISNV QAEDLADYFCQQHYSTPPTFG GGTKLEIK | 1059 | KSSQSLLNSSSQKNYLA | 1179 | FASTRES | 1299 | QQHYSTPPT | 1419 |
| VK-510 | DVVMTQTPLSLPVSLGDHASI SCRSSQSLIHSNGNNYLHWYL QKPGQSPQLLIYKVSNRFSGV PDRFSGSGSGTDFTLKISRVE AEDLGVYFCSQSTLVPLTFGS GTKLELR | 1060 | RSSQSLIHSNGNNYLH | 1180 | KVSNRFS | 1300 | SQSTLVPLT | 1420 |
| VK-511 | DVVMTQTPLSLPVSLGDHASI SCRSSQSLVHSNGNIYLHWYL QRPGQSPKLLIHKVSNRFSGV PDRFSGSGSGTDFTLKISRVE AEDVGIYFCSQSTLVPLTFGS GTKLELK | 1061 | RSSQSLVHSNGNIYLH | 1181 | KVSNRFS | 1301 | SQSTLVPLT | 1421 |
| VK-518 | DVVMTQTPLSLPVSLGDHASI SCRSSQSLVHSNGNTYLHWYL QRPGQSPKLLIHKVSNRFSGV PDRFSGSGSGTDFTLKISRVE AEDVGIYFCSQSTLVPLTFGS GTKLELK | 1062 | RSSQSLVHSNGNTYLH | 1182 | KVSNRFS | 1302 | SQSTLVPLT | 1422 |
| VK-528 | DVVMTQTPLSLPVSLGDHASI SCRSSQSLIHSNGNNYLHWYL QKPGQSPKLLIYKVSNRFSGV PDRFSGSGSGTDFTLKISRVE AEDLGVYFCSQSTLVPLTFGS GTKLELK | 1063 | RSSQSLIHSNGNNYLH | 1183 | KVSNRFS | 1303 | SQSTLVPLT | 1423 |
| VK-521 | DVVMTQSPLSLPVSLGDHASI SCRSSQSLIHSNGNNYLHWYL QKPGQSPKLLIYTVSNRFSGV PDRFSGSGSGTDFTLKISRVE AEDLGVYFCSQSTLVPLTFGS GTKLEVK | 1064 | RSSQSLIHSNGNNYLH | 1184 | TVSNRFS | 1304 | SQSTLVPLT | 1424 |
| VK-530 | DVVMTQTPLSLPVSLGDHASI SCRSSQSLIHSNGNNYLHWYL QKPGQSPKLLIYTVSNRFSGV PDRFSGSGSGTDFTLKISRVE AEDLGVYFCSQSTLVPLTFGS GTKLEVK | 1065 | RSSQSLIHSNGNNYLH | 1185 | TVSNRFS | 1305 | SQSTLVPLT | 1425 |
| VK-541 | DIVMTQTPLSLPVSLGDQASI SCRSSQSLVHSSGNTYLHWYL QKPGQSPKLLIYKVSNRFSGV PDRFSGSGSGTDFTLRISRVA AEDLGVYFCSQSTLVPVTFGA GTELELK | 1066 | RSSQSLVHSSGNTYLH | 1186 | KVSNRFS | 1306 | SQSTLVPVT | 1426 |

TABLE 3B-continued

The amino acid sequences of the light chain variable region (VL) and Kabat LCDRs of the exemplary anti-C5aR1 antibodies are provided as follows.

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-547 | DVVMTQTPLSLPVSLGNQASISCRSSQRLVHSNGNTYLHWYLQKPGQSPKLLIYKVFNRFSGVPDRFSGSGSGTDFTLKISRVEAEDLGIYFCAQSTLVPPTFGGGTKLEIK | 1067 | RSSQRLVHSNGNTYLH | 1187 | KVFNRFS | 1307 | AQSTLVPPT | 1427 |
| VK-549 | DVVMTQTPLSLPVSLGDQASISCRSSQSLVHSSENTYLHWYLQKPGQSPKLLIYKVSNRFSGVPDRFSGSGSGTDFTLKISRVEAEDLGVYFCSQSTLVPVTFGAGTKLELK | 1068 | RSSQSLVHSSENTYLH | 1188 | KVSNRFS | 1308 | SQSTLVPVT | 1428 |
| VK-550 | DVVMTQTPLSLPVSLGNQASISCRSSQSLVHSNGNTYLHWYLQKPGQSPRLLIYKVFNRFSGVPDRFSGSGSGTDFTLKISRVEAEDLGVYFCAQSTLVPPTFGGGTKLEIK | 1069 | RSSQSLVHSNGNTYLH | 1189 | KVFNRFS | 1309 | AQSTLVPPT | 1429 |
| VK-553 | DVVMTQTPLSLPVSLGDQASISCRSSQSLVHSSENTYLHWYVQKPGQSPKLLIYKVSNRFSGVPDRFSGSGSGTDFTLKISRVEAEDLGVYFCSQSTLVPVTFGAGTKLELK | 1070 | RSSQSLVHSSENTYLH | 1190 | KVSNRFS | 1310 | SQSTLVPVT | 1430 |
| VK-556 | DVVMTQTPLSLPVSLGNQASISCRSSQSLVHSNGNTYLHWYLQKPGQSPRLLIYKVFNRFPGVPDRFSGSGSGTDFTLKISRVEAEDLGVYFCAQSTLVPPTFGGGTKLEIK | 1071 | RSSQSLVHSNGNTYLH | 1191 | KVFNRFP | 1311 | AQSTLVPPT | 1431 |
| VK-557 | DVVMTQTPLSLPVSLGDQASISCRSSQSLVHSSGNTYLHWYLQKPGQSPKLLIYKVSNRFSGVPDRFSGSGSGTHFTLKLSRVEAEDLGIYFCSQSTLIPLTFGAGTKLEL | 1072 | RSSQSLVHSSGNTYLH | 1192 | KVSNRFS | 1312 | SQSTLIPLT | 1432 |
| VK-567 | DIQMTQSPSSLSASLGEKVSLTCRASQEISGYLSWLQQKPDGSIKRLIYAASTLDSGVPKRFSGSRSGSVYSLTISSLESEDFADYYCLHYANYPPTFGGGTKLEIR | 1073 | RASQEISGYLS | 1193 | AASTLDS | 1313 | LHYANYPPT | 1433 |
| VK-568 | DVQMTQSPSSLSASLGDTITITCHASQNIYVWLNWFQQKPGNIPKLLISKASDLHTGVPSRFSGSGSGTGFTLTISSLQPEDIATYYCQQGLSYPLTFGGGTNLEIK | 1074 | HASQNIYVWLN | 1194 | KASDLHT | 1314 | QQGLSYPLT | 1434 |
| VK-583 | DVVMTQTPLSPPVSLGYQASISCRSSQSLVHSNGNTYLNWYLQKPGQSPKLLIYKVSNRLSGVPDRFSGSGSGTDFTLKISRVETEDLGVYFCSQSTHVPYTFGGGTKLEIK | 1075 | RSSQSLVHSNGNTYLN | 1195 | KVSNRLS | 1315 | SQSTHVPYT | 1435 |
| VK-584 | DVVMTQTPLSLPVSLGDRASISCRSGQSLVHSNGNTYLHWYLQRPGRSPNLLIYKVSNRFSGVPDRFSGSGSGTDFTLKISRVEAEDLGVYFCSQSTHVPWTFGGGTKLEIK | 1076 | RSGQSLVHSNGNTYLH | 1196 | KVSNRFS | 1316 | SQSTHVPWT | 1436 |

TABLE 3B-continued

The amino acid sequences of the light chain variable region (VL) and Kabat LCDRs of the exemplary anti-C5aR1 antibodies are provided as follows.

| Name | VL sequence | SEQ ID NO: | LCDR1 | SEQ ID NO: | LCDR2 | SEQ ID NO: | LCDR3 | SEQ ID NO: |
|---|---|---|---|---|---|---|---|---|
| VK-585 | DVVMTQTPLSLPVSLGDQASI SCRFSQSIVYSNGNTYLQWYL QKPGQSPKLLIYKVSNRFSGV PDRFSGSGSGTDFTLKISRVE AEDLGVYYCFQGSHVPPTFGG GTKLEIK | 1077 | RFSQSIVYSNGNTYLQ | 1197 | KVSNRFS | 1317 | FQGSHVPPT | 1437 |
| VK-586 | DVVMTQTPLTLSVTIGQPTSI SCKSSQSLLYSNGKTYLSWLL QRPGQSPKRLIYLVSKLDSGV PDRFTGSGSGTDFTLKINRVE AEDLGLYYCVQNTHLPYTFGG GTKLEIR | 1078 | KSSQSLLYSNGKTYLS | 1198 | LVSKLDS | 1318 | VQNTHLPYT | 1438 |
| VK-588 | DIQMTQSTSSLSASLGDRVTI SCRASQDISNYLNWYQQTPDG TVKLLIYQISRLHSGVPSRFS GSGSGTDYSLTISNLEEEDIA NYFCQQGNSLPPTFGGGTKVE IK | 1079 | RASQDISNYLN | 1199 | QISRLHS | 1319 | QQGNSLPPT | 1439 |
| VK-592 | DIQMNQSPSSLSASLGDTITI TCHASQNIDVWLSWYQQKPGN IPKLLIYKASNLHTGVPSRFS GRDSGTAFTLTISSLQPEDIA TYYCQQGHSYPLTFGSGTKLE LK | 1080 | HASQNIDVWLS | 1200 | KASNLHT | 1320 | QQGHSYPLT | 1440 |

In an embodiment, the antibody molecule comprises one, two, or three CDRs of the VH described herein, e.g., in Table 1A, 2A, or 3A (e.g., any of VH-11, VH-11v2, VH-66, VH-79, VH-184, VH-216, VH-272, VH-308, VH-317, VH-317v2, VH-322, VH-329, VH-330, VH-332, VH-335, VH-336v1, VH-336v2, VH-336v3, VH-338, VH-341v1, VH-341v2, VH-343, VH-399, VH-402, VH-416, VH-429, VH-430, VH-440, VH-453, VH-454, VH-465, VH-475, VH-481, VH-497, VH-502, VH-503, VH-504, VH-507, VH-508, VH-510, VH-511, VH-521, VH-530, VH-536, VH-541, VH-547, VH-549, VH-550, VH-553, VH-556, VH-557, VH-567, VH-568, VH-570, VH-573, VH-583, VH-584, VH-585, VH-586, VH-588, or VH-592), using the IMGT, Kabat, or Chothia definitions of CDRs.

In an embodiment, the antibody molecule comprises one, two, or three CDRs of the VL described herein, e.g., in Table 1B, 2B, or 3B (e.g., any of VK-11, VK-66, VK-79, VK-184, VK-184CY, VK-216_272, VK-308, VK-317, VK-317v2, VK-322, VK-329, VK-330, VK-332, VK-335, VK-336v1, VK-336v2, VK-338v1, VK-338v2, VK-341v1, VK-341v2, VK-343, VK-399, VK-402, VK-416, VK-429, VK-430, VK-440, VK-453, VK-454, VK-465, VK-475, VK-481, VK-497, VK-502, VK-503, VK-504, VK-507, VK-508, VK-510, VK-511, VK-518, VK-528, VK-521, VK-530, VK-541, VK-547, VK-549, VK-550, VK-553, VK-556, VK-557, VK-567, VK-568, VK-583, VK-584, VK-585, VK-586, VK-588, VK-592), using the IMGT, Kabat, or Chothia definitions of CDRs.

In an embodiment, the antibody molecule comprises one, two, or three CDRs of the VH of an antibody molecule described herein, e.g., in Table 1A, 2A, or 3A (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592, e.g., as listed in Table 1C), using the IMGT, Kabat, or Chothia definitions of CDRs. In an embodiment, the antibody molecule comprises one, two, or three CDRs of the VH of an antibody molecule described herein, e.g., in Table 1A, 2A, or 3A (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592, e.g., as listed in Table 1C), using the IMGT, Kabat, or Chothia definitions of CDRs.

In an embodiment, the antibody molecule comprises one, two, or three CDRs of the VL region of an antibody molecule described herein, e.g., in Table 1B, 2B, or 3B (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C)), using the IMGT, Kabat, or Chothia definitions of CDRs.

In an embodiment, the antibody molecule comprises one, two, or three CDRs of the VH described herein, e.g., in Table 1A, 2A, or 3A (e.g., any of VH-11, VH-11v2, VH-66, VH-79, VH-184, VH-216, VH-272, VH-308, VH-317, VH-317v2, VH-322, VH-329, VH-330, VH-332, VH-335, VH-336v1, VH-336v2, VH-336v3, VH-338, VH-341v1, VH-341v2, VH-343, VH-399, VH-402, VH-416, VH-429, VH-430, VH-440, VH-453, VH-454, VH-465, VH-475, VH-481, VH-497, VH-502, VH-503, VH-504, VH-507, VH-508, VH-510, VH-511, VH-521, VH-530, VH-536, VH-541, VH-547, VH-549, VH-550, VH-553, VH-556, VH-557, VH-567, VH-568, VH-570, VH-573, VH-583, VH-584, VH-585, VH-586, VH-588, or VH-592), using the IMGT, Kabat, or Chothia definitions of CDRs; and one, two, or three CDRs of the VL described herein, e.g., in Table 1B, 2B, or 3B (e.g., any of VK-11, VK-66, VK-79, VK-184, VK-184_C_Y, VK-216_272, VK-308, VK-317, VK-317v2, VK-322, VK-329, VK-330, VK-332, VK-335, VK-336v1, VK-336v2, VK-338v1, VK-338v2, VK-341v1, VK-341v2, VK-343, VK-399, VK-402, VK-416, VK-429, VK-430, VK-440, VK-453, VK-454, VK-465, VK-475, VK-481, VK-497, VK-502, VK-503, VK-504, VK-507, VK-508, VK-510, VK-511, VK-518, VK-528, VK-521, VK-530, VK-541, VK-547, VK-549, VK-550, VK-553, VK-556, VK-557, VK-567, VK-568, VK-583, VK-584, VK-585, VK-586, VK-588, VK-592), using the IMGT, Kabat, or Chothia definitions of CDRs.

In an embodiment, the antibody molecule comprises one, two, or three CDRs of the VH of an antibody molecule described herein, e.g., in Table 1A, 2A, or 3A (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592, e.g., as listed in Table 1C), using the IMGT, Kabat, or Chothia definitions of CDRs; and one, two, or three CDRs of the VL region of an antibody molecule described herein, e.g., in Table 1B, 2B, or 3B (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C)), using the IMGT, Kabat, or Chothia definitions of CDRs.

In an embodiment, the antibody molecule comprises one, two, or three HCDRs described in Table 1A, 2A, or 3A. In an embodiment, the antibody molecule comprises one, two, or three LCDRs described in Table 1B, 2B, or 3B. In an embodiment, the antibody molecule comprises one, two, or three HCDRs described in Table 1A, 2A, or 3A; and one, two, or three LCDRs described in Table 1B, 2B, or 3B.

In an embodiment, the antibody molecule comprises one, two, or three CDRs of the VL region of an antibody molecule described herein, e.g., in Table 1B, 2B, or 3B (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C)), using the IMGT, Kabat, or Chothia definitions of CDRs.

In an embodiment, the antibody molecule comprises one, two, or three CDRs of the VH described herein, e.g., in Table 1A, 2A, or 3A (e.g., any of VH-11, VH-11v2, VH-66, VH-79, VH-184, VH-216, VH-272, VH-308, VH-317, VH-317v2, VH-322, VH-329, VH-330, VH-332, VH-335, VH-336v1, VH-336v2, VH-336v3, VH-338, VH-341v1, VH-341v2, VH-343, VH-399, VH-402, VH-416, VH-429, VH-430, VH-440, VH-453, VH-454, VH-465, VH-475, VH-481, VH-497, VH-502, VH-503, VH-504, VH-507, VH-508, VH-510, VH-511, VH-521, VH-530, VH-536, VH-541, VH-547, VH-549, VH-550, VH-553, VH-556, VH-557, VH-567, VH-568, VH-570, VH-573, VH-583, VH-584, VH-585, VH-586, VH-588, or VH-592), using the IMGT, Kabat, or Chothia definitions of CDRs; and one, two, or three CDRs of the VL described herein, e.g., in Table 1B, 2B, or 3B (e.g., any of VK-11, VK-66, VK-79, VK-184, VK-184_C_Y, VK-216_272, VK-308, VK-317, VK-317v2, VK-322, VK-329, VK-330, VK-332, VK-335, VK-336v1, VK-336v2, VK-338v1, VK-338v2, VK-341v1, VK-341v2, VK-343, VK-399, VK-402, VK-416, VK-429, VK-430, VK-440, VK-453, VK-454, VK-465, VK-475, VK-481, VK-497, VK-502, VK-503, VK-504, VK-507, VK-508, VK-510, VK-511, VK-518, VK-528, VK-521, VK-530, VK-541, VK-547, VK-549, VK-550, VK-553, VK-556, VK-557, VK-567, VK-568, VK-583, VK-584, VK-585, VK-586, VK-588, VK-592), using the IMGT, Kabat, or Chothia definitions of CDRs.

In an embodiment, the antibody molecule comprises one, two, or three CDRs of the VH of an antibody molecule described herein, e.g., in Table 1A, 2A, or 3A (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592, e.g., as listed in Table 1C), using the IMGT, Kabat, or Chothia definitions of CDRs; and one, two, or three CDRs of the VL region of an antibody molecule described herein, e.g., in Table 1B, 2B, or 3B (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C)), using the IMGT, Kabat, or Chothia definitions of CDRs.

In an embodiment, the antibody molecule comprises one, two, or three HCDRs described in Table 1A, 2A, or 3A. In an embodiment, the antibody molecule comprises one, two, or three LCDRs described in Table 1B, 2B, or 3B. I n an embodiment, the antibody molecule comprises one, two, or three HCDRs described in Table 1A, 2A, or 3A; and one, two, or three LCDRs described in Table 1B, 2B, or 3B.

In an embodiment, the antibody molecule comprises HCDR1, HCDR2, and HCDR3 described in the same row of Table 1A, 2A, or 3A. In an embodiment, the antibody molecule comprises LCDR1, LCDR2, and LCDR3 described in the same row described in the same row of Table 1B, 2B, or 3B. In an embodiment, the antibody molecule comprises HCDR1, HCDR2, and HCDR3 described in the same row of Table 1A, 2A, or 3A; and LCDR1, LCDR2, and LCDR3 described in the same row of Table 1B, 2B, or 3B.

In an embodiment, the antibody molecule comprises one, two, three, or four frameworks of the VH described herein, e.g., in Table 1A, 2A, or 3A (e.g., any of VH-11, VH-11v2, VH-66, VH-79, VH-184, VH-216, VH-272, VH-308, VH-317, VH-317v2, VH-322, VH-329, VH-330, VH-332, VH-335, VH-336v1, VH-336v2, VH-336v3, VH-338, VH-341v1, VH-341v2, VH-343, VH-399, VH-402, VH-416, VH-429, VH-430, VH-440, VH-453, VH-454, VH-465, VH-475, VH-481, VH-497, VH-502, VH-503, VH-504, VH-507, VH-508, VH-510, VH-511, VH-521, VH-530, VH-536, VH-541, VH-547, VH-549, VH-550, VH-553, VH-556, VH-557, VH-567, VH-568, VH-570, VH-573, VH-583, VH-584, VH-585, VH-586, VH-588, or VH-592), using the IMGT, Kabat, or Chothia definitions of CDRs.

In an embodiment, the antibody molecule comprises one, two, three, or four frameworks of the VH of an antibody molecule described herein, e.g., in Table 1A, 2A, or 3A (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592, e.g., as listed in Table 1C), using the IMGT, Kabat, or Chothia definitions of CDRs. In an embodiment, the antibody molecule comprises one, two, three, or four frameworks of the VH of an antibody molecule described herein, e.g., in Table 1A, 2A, or 3A (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592, e.g., as listed in Table 1C), using the IMGT, Kabat, or Chothia definitions of CDRs. In an embodiment, the antibody molecule comprises one, two, three, or four frameworks of the VL described herein, e.g., in Table 1B, 2B, or 3B (e.g., any of VK-11, VK-66, VK-79, VK-184, VK-184CY, VK-216_272, VK-308, VK-317, VK-317v2, VK-322, VK-329, VK-330, VK-332, VK-335, VK-336v1, VK-336v2, VK-338v1, VK-338v2, VK-341v1, VK-341v2, VK-343, VK-399, VK-402, VK-416, VK-429, VK-430, VK-440, VK-453, VK-454, VK-465, VK-475, VK-481, VK-497, VK-502, VK-503, VK-504, VK-507, VK-508, VK-510, VK-511, VK-518, VK-528, VK-521, VK-530, VK-541, VK-547, VK-549, VK-550, VK-553, VK-556, VK-557, VK-567, VK-568, VK-583, VK-584, VK-585, VK-586, VK-588, VK-592), using the IMGT, Kabat, or Chothia definitions of CDRs.

In an embodiment, the antibody molecule comprises one, two, three, or four frameworks of the VL region of an antibody molecule described herein, e.g., in Table 1B, 2B, or 3B (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C)), using the IMGT, Kabat, or Chothia definitions of CDRs.

In an embodiment, the antibody molecule comprises one, two, three, or four frameworks of the VH described herein, e.g., in Table 1A, 2A, or 3A (e.g., any of VH-11, VH-11v2, VH-66, VH-79, VH-184, VH-216, VH-272, VH-308, VH-317, VH-317v2, VH-322, VH-329, VH-330, VH-332, VH-335, VH-336v1, VH-336v2, VH-336v3, VH-338, VH-341v1, VH-341v2, VH-343, VH-399, VH-402, VH-416, VH-429, VH-430, VH-440, VH-453, VH-454, VH-465, VH-475, VH-481, VH-497, VH-502, VH-503, VH-504, VH-507, VH-508, VH-510, VH-511, VH-521, VH-530, VH-536, VH-541, VH-547, VH-549, VH-550, VH-553, VH-556, VH-557, VH-567, VH-568, VH-570, VH-573, VH-583, VH-584, VH-585, VH-586, VH-588, or VH-592), using the IMGT, Kabat, or Chothia definitions of CDRs; and one, two, three, or four frameworks of the VL described herein, e.g., in Table 1B, 2B, or 3B (e.g., any of VK-11, VK-66, VK-79, VK-184, VK-184_C_Y, VK-216_272, VK-308, VK-317, VK-317v2, VK-322, VK-329, VK-330, VK-332, VK-335, VK-336v1, VK-336v2, VK-338v1, VK-338v2, VK-341v1, VK-341v2, VK-343, VK-399, VK-402, VK-416, VK-429, VK-430, VK-440, VK-453, VK-454, VK-465, VK-475, VK-481, VK-497, VK-502, VK-503, VK-504, VK-507, VK-508, VK-510, VK-511, VK-518, VK-528, VK-521, VK-530, VK-541, VK-547, VK-549, VK-550, VK-553, VK-556, VK-557, VK-567, VK-568, VK-583, VK-584, VK-585, VK-586, VK-588, VK-592), using the IMGT, Kabat, or Chothia definitions of CDRs.

In an embodiment, the antibody molecule comprises one, two, three, or four frameworks of the VH of an antibody molecule described herein, e.g., in Table 1A, 2A, or 3A (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592, e.g., as listed in Table 1C), using the IMGT, Kabat, or Chothia definitions of CDRs; and one, two, three, or four frameworks of the VL region of an antibody molecule described herein, e.g., in Table 1B, 2B, or 3B (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C)), using the IMGT, Kabat, or Chothia definitions of CDRs. In an embodiment, the antibody molecule comprises all heavy chain frameworks described in the same row of Table 1A, 2A, or 3A. In an embodiment, the antibody molecule comprises all light chain frameworks described in the same row described in the same row of Table 1B, 2B, or 3B. In an embodiment, the antibody molecule comprises all heavy chain frameworks described in the same row of Table 1A, 2A, or 3A; and all light chain frameworks described in the same row of Table 1B, 2B, or 3B.

In an embodiment, the antibody molecule comprises a VH comprising an amino acid sequence described in Table 1A, 2A, or 3A (e.g., any of VH-11, VH-11v2, VH-66, VH-79, VH-184, VH-216, VH-272, VH-308, VH-317, VH-317v2, VH-322, VH-329, VH-330, VH-332, VH-335, VH-336v1, VH-336v2, VH-336v3, VH-338, VH-341v1, VH-341v2, VH-343, VH-399, VH-402, VH-416, VH-429, VH-430, VH-440, VH-453, VH-454, VH-465, VH-475, VH-481, VH-497, VH-502, VH-503, VH-504, VH-507, VH-508, VH-510, VH-511, VH-521, VH-530, VH-536, VH-541, VH-547, VH-549, VH-550, VH-553, VH-556, VH-557, VH-567, VH-568, VH-570, VH-573, VH-583, VH-584, VH-585, VH-586, VH-588, or VH-592), or an amino acid sequence substantially identical thereto. In an embodiment, the antibody molecule comprises a VL comprising an amino acid sequence described in Table 1B, 2B, or 3B (e.g., any of VK-11, VK-66, VK-79, VK-184, VK-184CY, VK-216_272, VK-308, VK-317, VK-317v2, VK-322, VK-329, VK-330, VK-332, VK-335, VK-336v1, VK-336v2, VK-338v1, VK-338v2, VK-341v1, VK-341v2, VK-343, VK-399, VK-402, VK-416, VK-429, VK-430, VK-440, VK-453, VK-454, VK-465, VK-475, VK-481, VK-497, VK-502, VK-503, VK-504, VK-507, VK-508, VK-510, VK-511, VK-518, VK-528, VK-521, VK-530, VK-541, VK-547, VK-549, VK-550, VK-553, VK-556, VK-557, VK-567, VK-568, VK-583, VK-584, VK-585, VK-586, VK-588, VK-592), or an amino acid sequence substantially identical thereto.

In an embodiment, the antibody molecule comprises a VH comprising an amino acid sequence described in Table 1A, 2A, or 3A (e.g., any of VH-11, VH-11v2, VH-66, VH-79, VH-184, VH-216, VH-272, VH-308, VH-317, VH-317v2, VH-322, VH-329, VH-330, VH-332, VH-335, VH-336v1, VH-336v2, VH-336v3, VH-338, VH-341v1, VH-341v2, VH-343, VH-399, VH-402, VH-416, VH-429, VH-430, VH-440, VH-453, VH-454, VH-465, VH-475, VH-481, VH-497, VH-502, VH-503, VH-504, VH-507, VH-508, VH-510, VH-511, VH-521, VH-530, VH-536, VH-541, VH-547, VH-549, VH-550, VH-553, VH-556, VH-557, VH-567, VH-568, VH-570, VH-573, VH-583, VH-584, VH-585, VH-586, VH-588, or VH-592), or an amino acid sequence substantially identical thereto; and a VL comprising an amino acid sequence described in Table 1B, 2B, or 3B (e.g., any of VK-11, VK-66, VK-79, VK-184, VK-184CY, VK-216_272, VK-308, VK-317, VK-317v2, VK-322, VK-329, VK-330, VK-332, VK-335, VK-336v1, VK-336v2, VK-338v1, VK-338v2, VK-341v1, VK-341v2, VK-343, VK-399, VK-402, VK-416, VK-429, VK-430, VK-440, VK-453, VK-454, VK-465, VK-475, VK-481, VK-497, VK-502, VK-503, VK-504, VK-507, VK-508, VK-510, VK-511, VK-518, VK-528, VK-521, VK-530, VK-541, VK-547, VK-549, VK-550, VK-553, VK-556, VK-557, VK-567, VK-568, VK-583, VK-584, VK-585, VK-586, VK-588, VK-592), or an amino acid sequence substantially identical thereto. In an embodiment, the antibody molecule comprises a VH comprising an amino acid sequence described in Table 1A, 2A, or 3A (e.g., any of VH-11, VH-11v2, VH-66, VH-79, VH-184, VH-216, VH-272, VH-308, VH-317, VH-317v2, VH-322, VH-329, VH-330, VH-332, VH-335, VH-336v1, VH-336v2, VH-336v3, VH-338, VH-341v1, VH-341v2, VH-343, VH-399, VH-402, VH-416, VH-429, VH-430, VH-440, VH-453, VH-454, VH-465, VH-475, VH-481, VH-497, VH-502, VH-503, VH-504, VH-507, VH-508, VH-510, VH-511, VH-521, VH-530, VH-536, VH-541, VH-547, VH-549, VH-550, VH-553, VH-556, VH-557, VH-567, VH-568, VH-570, VH-573, VH-583, VH-584, VH-585, VH-586, VH-588, or VH-592), or an amino acid sequence substantially identical thereto; and a VL comprising an amino acid sequence described in Table 1B, 2B, or 3B (e.g., any of VK-11, VK-66, VK-79, VK-184, VK-184_C_Y, VK-216_272, VK-308, VK-317, VK-317v2, VK-322, VK-329, VK-330, VK-332, VK-335, VK-336v1, VK-336v2, VK-338v1, VK-338v2, VK-341v1, VK-341v2, VK-343, VK-399, VK-402, VK-416, VK-429, VK-430, VK-440, VK-453, VK-454, VK-465, VK-475, VK-481, VK-497, VK-502, VK-503, VK-504, VK-507, VK-508, VK-510, VK-511, VK-518, VK-528, VK-521, VK-530, VK-541, VK-547, VK-549, VK-550, VK-553, VK-556, VK-557, VK-567, VK-568, VK-583, VK-584, VK-585, VK-586, VK-588, VK-592), or an amino acid sequence substantially identical thereto. In an embodiment, the antibody molecule comprises a VH of an antibody molecule described herein, e.g., in Table 1A, 2A, or 3A (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592, e.g., as listed in Table 1C). In an embodiment, the antibody molecule comprises a VL of an antibody molecule described herein, e.g., in Table 1B, 2B, or 3B (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592, e.g., as listed in Table 1C). In an embodiment, the antibody molecule comprises a VH of an antibody molecule described herein, e.g., in Table 1A, 2A, or 3A (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592, e.g., as listed in Table 1C); and a VL of an antibody molecule described herein, e.g., in Table 1B, 2B, or 3B (e.g., any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592, e.g., as listed in Table 1C).

In an embodiment, the antibody molecule further comprises a heavy chain constant region. In an embodiment, the heavy chain constant region is an IgG1 constant region, e.g., any of SEQ ID NOS: 1441-1443, or a functional portion thereof. In another embodiment, the heavy chain constant region is an IgG2 constant region, e.g., any of SEQ ID NOS: 1444-1447, or a functional portion thereof. In an embodiment, the antibody molecule further comprises a light chain constant region. In an embodiment, the antibody molecule further comprises a heavy chain constant region and a light chain constant region. In certain embodiments, the antibody molecule comprises a heavy chain constant region, a light chain constant region, and variable regions that comprise one, two, three, four, five, or six CDRs of a VH described in Table 1A, 2A, or 3A, and/or a VL described in Table 1B, 2B, or 3B. In certain embodiments, the antibody molecule comprises a heavy chain constant region, a light chain constant region, and variable regions that comprise one, two, three, four, five, or six CDRs of an antibody molecule described in Table 1C. In an embodiment, the antibody molecule comprises a heavy chain constant region, a light chain constant region, a VH described in Table 1A, 2A, or 3A, and a VL described in Table 1B, 2B, or 3B.

Exemplary heavy chain constant regions are described below.

```
Exemplary IgG1 constant regions
>IGHG1*01
                              (SEQ ID NO: 1441)
STKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVE

PKSCDKTHTCPPCPAPELLGGPSVFLEPPKPKDTLMISRTPEVTCVVVD

VSHEDPEVKFNWYVDGVEVHNAKTKPREEQYNSTYRVVSVLTVLHQDWL

NGKEYKCKVSNKALPAPIEKTISKAKGQPREPQVYTLPPSRDELTKNQV
```

-continued
SLTCLVKGFYPSDIAVEWESNGQPENNYKTTPPVLDSDGSFFLYSKLTV

DKSRWQQGNVFSCSVMHEALHNHYTQKSLSLSP

>IGHG1*03
(SEQ ID NO: 1442)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSP

>IGHG1*04
(SEQ ID NO: 1443)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSRDELTKNQ

VSLTCLVKGFYPSDIAVEWESNGQPENNYKTTPPVLDSDGSFFLYSKLT

VDKSRWQQGNIFSCSVMHEALHNHYTQKSLSLSP

Exemplary IgG2 constant regions
>IGHG2*01
(SEQ ID NO: 1444)
STKGPSVFPLAPCSRSTSESTAALGCLVKDYFPEPVTVSWNSGALTSGV

HTFPAVLQSSGLYSLSSVVTVPSSNFGTQTYTCNVDHKPSNTKVDKTVE

RKCCVECPPCPAPPVAGPSVFLFPPKPKDTLMISRTPEVTCVVVDVSHE

DPEVQFNWYVDGVEVHNAKTKPREEQFNSTFRVVSVLTVVHQDWLNGKE

YKCKVSNKGLPAPIEKTISKTKGQPREPQVYTLPPSREEMTKNQVSLTC

LVKGFYPSDIAVEWESNGQPENNYKTTPPMLDSDGSFFLYSKLTVDKSR

WQQGNVFSCSVMHEALHNHYTQKSLSLSP

>IGHG2*02
(SEQ ID NO: 1445)
STKGPSVFPLAPCSRSTSESTAALGCLVKDYFPEPVTVSWNSGALTSGV

HTFPAVLQSSGLYSLSSVVTVTSSNFGTQTYTCNVDHKPSNTKVDKTVE

RKCCVECPPCPAPPVAGPSVFLFPPKPKDTLMISRTPEVTCVVVDVSHE

DPEVQFNWYVDGMEVHNAKTKPREEQFNSTFRVVSVLTVVHQDWLNGKE

YKCKVSNKGLPAPIEKTISKTKGQPREPQVYTLPPSREEMTKNQVSLTC

LVKGFYPSDIAVEWESNGQPENNYKTTPPMLDSDGSFFLYSKLTVDKSR

WQQGNVFSCSVMHEALHNHYTQKSLSLSP

>IGHG2*04
(SEQ ID NO: 1446)
STKGPSVFPLAPCSRSTSESTAALGCLVKDYFPEPVTVSWNSGALTSGV

HTFPAVLQSSGLYSLSSVVTVPSSSLGTQTYTCNVDHKPSNTKVDKTVE

RKCCVECPPCPAPPVAGPSVFLFPPKPKDTLMISRTPEVTCVVVDVSHE

DPEVQFNWYVDGVEVHNAKTKPREEQFNSTFRVVSVLTVVHQDWLNGKE

YKCKVSNKGLPAPIEKTISKTKGQPREPQVYTLPPSREEMTKNQVSLTC

LVKGFYPSDIAVEWESNGQPENNYKTTPPMLDSDGSFFLYSKLTVDKSR

WQQGNVFSCSVMHEALHNHYTQKSLSLSP

>IGHG2*06
(SEQ ID NO: 1447)
STKGPSVFPLAPCSRSTSESTAALGCLVKDYFPEPVTVSWNSGALTSGV

HTFPAVLQSSGLYSLSSVVTVPSSNFGTQTYTCNVDHKPSNTKVDKTVE

RKCCVECPPCPAPPVAGPSVFLFPPKPKDTLMISRTPEVTCVVVDVSHE

DPEVQFNWYVDGVEVHNAKTKPREEQFNSTFRVVSVLTVVHQDWLNGKE

YKCKVSNKGLPAPIEKTISKTKGQPREPQVYTLPPSREEMTKNQVSLTC

LVKGFYPSDISVEWESNGQPENNYKTTPPMLDSDGSFFLYSKLTVDKSR

WQQGNVFSCSVMHEALHNHYTQKSLSLSP

In an embodiment, the antibody molecule is capable of binding, or substantially binding, to human C5aR1. In an embodiment, the antibody molecule binds to C5aR1 with high affinity, e.g., with a dissociation constant ($K_D$) of less than about 100 nM, less than about 80 nM, less than about 60 nM, less than about 50 nM, less than about 40 nM, less than about 25 nM, less than about 10 nM, and more typically, about 10-0.001 nM, about 10-0.01 nM, about 10-0.01 nM, about 5-0.01 nM, about 3-0.05 nM, about 1-0.1 nM, or stronger, e.g., less than about 80, 70, 60, 50, 40, 30, 20, 10, 8, 6, 4, 3, 2, 1, 0.5, 0.2, 0.1, 0.05, 0.01, 0.005, or 0.001 nM. In an embodiment, the antibody molecule binds to C5aR1 with a $K_{off}$ slower than $1\times10^{-4}$, $5\times10^{-5}$, or $1\times10^{-5}$ s$^{-1}$. In an embodiment, the antibody molecule binds to C5aR1 with a $K_{on}$ faster than $1\times10^4$, $5\times10^4$, $1\times10^5$, or $5\times10^5$ M$^{-1}$s$^{-1}$.

In an embodiment, the antibody molecule inhibits binding of human C5aR1 to human C5a by 50% or more, e.g., 60% or more, 70% or more, 80% or more, 85% or more, 90% or more, 95% or more, 96% or more, 97% or more, 98% or more, 99% or more, or 100%, as determined by a method described herein (e.g., normalized to the no antibody control).

In an embodiment, the antibody molecule binds to a linear or conformational epitope on C5aR1. In an embodiment, the antibody molecule binds to an epitope conserved between human C5aR1 and mouse C5aR1. In an embodiment, the antibody molecule binds to an epitope described herein. In an embodiment, the antibody molecule binds, or substantially binds, to the same, similar, or overlapping epitope on C5aR1, as a second antibody molecule (e.g., an antibody molecule described in Table 1C). In an embodiment, the antibody molecule competes with a second antibody molecule (e.g., an antibody molecule described in Table 1C) for binding to C5aR1.

In an embodiment, the epitope is a linear epitope. In an embodiment, the epitope is a conformational epitope.

In an embodiment, the antibody molecule binds to the epitope of an antibody molecule as listed in Table 1C. In an embodiment, the epitope of the antibody molecule of Table 1C comprises a cyclic ECL2 region (e.g., comprised in Site II), and/or comprising a sulfated N-terminal (e.g., comprised in Site I) and/or a non-sulfated N-terminal (e.g., comprised in Site I).

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 11v2; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 11v2; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 11v2.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 322; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 322; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 322.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 329; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 329; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 329.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 330; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 330; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 330.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 336v2-1; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 336v2-1; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 336v2-1.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 402; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 402; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 402.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 429; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 429; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 429.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 430; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 430; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 430.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 440; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 440; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 440.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 453; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 453; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 453.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 454; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 454; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 454.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 465; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 465; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 465.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 475; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 475; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 475.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 507; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 507; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 507.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 510; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 510; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 510.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 511; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 511; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 511.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 518; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 518; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 518.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 528; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 528; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 528.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 541; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 541; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 541.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 547; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 547; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 547.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 549; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 549; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 549.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 550; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 550; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 550.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 553; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 553; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 553.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 556; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 556; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 556.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 567; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 567; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 567.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 568; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 568; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 568.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 570; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 570; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 570.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 573; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 573; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 573.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 583; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 583; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 583.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 584; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 584; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 584.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 585; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 585; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 585.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 586; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 586; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 586.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 588; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 588; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 588.

In an embodiment, the antibody molecule comprises a VH, wherein the VH comprises three HCDRs (HCDR1, HCDR2, and HCDR3), wherein the VH comprises one, two, or all of the following: (i) an HCDR1 comprising an amino acid sequence that differs by no more than 1, 2, or 3 amino acid residues from, or has at least 85, 90, 95, 99 or 100% homology with, the amino acid sequence of the HCDR1 of antibody 592; (ii) an HCDR2 comprising an amino acid sequence that differs by no more than 1, 2, or 3 amino acid residues from, or has at least 85, 90, 95, 99 or 100% homology with, the amino acid sequence of the HCDR2 of antibody 592; or (iii) an HCDR3 comprising an amino acid sequence that differs by no more than 1, 2, or 3 amino acid residues from, or has at least 85, 90, 95, 99 or 100% homology with, the amino acid sequence of the HCDR3 of antibody 592.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 11v2; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 11v2; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 11v2.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 322; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 322; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 322.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 329; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 329; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 329.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 330; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 330; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 330.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 336v2-1; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 336v2-1; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 336v2-1.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 402; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 402; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 402.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 429; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 429; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 429.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 430; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 430; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 430.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 440; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 440; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 440.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 453; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 453; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 453.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 454; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 454; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 454.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 465; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 465; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 465.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 475; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 475; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 475.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 507; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 507; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 507.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 510; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 510; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 510.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 511; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 511; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 511.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 518; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 518; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 518.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 528; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 528; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 528.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 541; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 541; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 541.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 547; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 547; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 547.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 549; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 549; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 549.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 550; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 550; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 550.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 553; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 553; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 553.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 556; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 556; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 556.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 567; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 567; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 567.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 568; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 568; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 568.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 570; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 570; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 570.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 573; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 573; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 573.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 583; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 583; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 583.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 584; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 584; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 584.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 585; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 585; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 585.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 586; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 586; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 586.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 588; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 588; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 588.

In an embodiment, the antibody molecule comprises a VL, wherein the VL comprises three LCDRs (LCDR1, LCDR2, and LCDR3), wherein the VL comprises one, two, or all of the following: (i) an LCDR1 comprising an amino acid sequence that differs by no more than 1, 2, or 3 amino acid residues from, or has at least 85, 90, 95, 99 or 100% homology with, the amino acid sequence of the LCDR1 of antibody 592; (ii) an LCDR2 comprising an amino acid sequence that differs by no more than 1, 2, or 3 amino acid residues from, or has at least 85, 90, 95, 99 or 100% homology with, the amino acid sequence of the LCDR2 of antibody 592; or (iii) an LCDR3 comprising an amino acid sequence that differs by no more than 1, 2, or 3 amino acid residues from, or has at least 85, 90, 95, 99 or 100% homology with, the amino acid sequence of the LCDR3 of antibody 592.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 11v2; an HCDR2 comprising an amino acid sequence that differs by no more than 1, 2, or 3 amino acid residues from, or has at least 85, 90, 95, 99 or 100% homology with, the amino acid sequence of the HCDR2 of antibody 11v2; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 11v2, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 11v2; an LCDR2 comprising an amino acid sequence that differs by no more than 1, 2, or 3 amino acid residues from, or has at least 85, 90, 95, 99 or 100% homology with, the amino acid sequence of the LCDR2 of antibody 11v2; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 11v2.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 322; an HCDR2 comprising an amino acid sequence that differs by no more than 1, 2, or 3 amino acid residues from, or has at least 85, 90, 95, 99 or 100% homology with, the amino acid sequence of the HCDR2 of antibody 322; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 322, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 322; an LCDR2 comprising an amino acid sequence that differs by no more than 1, 2, or 3 amino acid residues from, or has at least 85, 90, 95, 99 or 100% homology with, the amino acid sequence of the LCDR2 of antibody 322; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 322.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 329; an HCDR2 comprising an amino acid sequence that differs by no more than 1, 2, or 3 amino acid residues from, or has at least 85, 90, 95, 99 or 100% homology with, the amino acid sequence of the HCDR2 of antibody 329; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 329, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 329; an LCDR2 comprising an amino acid sequence that differs by no more than 1, 2, or 3 amino acid residues from, or has at least 85, 90, 95, 99 or 100% homology with, the amino acid sequence of the LCDR2 of antibody 329; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 329.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 330; an HCDR2 comprising an amino acid sequence that differs by no more than 1, 2, or 3 amino acid residues from, or has at least 85, 90, 95, 99 or 100% homology with, the amino acid sequence of the HCDR2 of antibody 330; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 330, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 330; an LCDR2 comprising an amino acid sequence that differs by no more than 1, 2, or 3 amino acid residues from, or has at least 85, 90, 95, 99 or 100% homology with, the amino acid sequence of the LCDR2 of antibody 330; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 330.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 336v2-1; an HCDR2 comprising an amino acid sequence that differs by no more than 1, 2, or 3 amino acid residues from, or has at least 85, 90, 95, 99 or 100% homology with, the amino acid sequence of the HCDR2 of antibody 336v2-1; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 336v2-1, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 336v2-1; an LCDR2 comprising an amino acid sequence that differs by no more than 1, 2, or 3 amino acid residues from, or has at least 85, 90, 95, 99 or 100% homology with, the amino acid sequence of the LCDR2 of antibody 336v2-1; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 336v2-1.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 402; an HCDR2 comprising an amino acid sequence that differs by no more than 1, 2, or 3 amino acid residues from, or has at least 85, 90, 95, 99 or 100% homology with, the amino acid sequence of the HCDR2 of antibody 402; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 402, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 402; an LCDR2 comprising an amino acid sequence that differs by no more than 1, 2, or 3 amino acid residues from, or has at least 85, 90, 95, 99 or 100% homology with, the amino acid sequence of the LCDR2 of antibody 402; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 402.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 429; an HCDR2 comprising an amino acid sequence that differs by no more than 1, 2, or 3 amino acid residues from, or has at least 85, 90, 95, 99 or 100% homology with, the amino acid sequence of the HCDR2 of antibody 429; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 429, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 429; an LCDR2 comprising an amino acid sequence that differs by no more than 1, 2, or 3 amino acid residues from, or has at least 85, 90, 95, 99 or 100% homology with, the amino acid sequence of the LCDR2 of antibody 429; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 429.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 430; an HCDR2 comprising an amino acid sequence that differs by no more than 1, 2, or 3 amino acid residues from, or has at least 85, 90, 95, 99 or 100% homology with, the amino acid sequence of the HCDR2 of antibody 430; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 430, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 430; an LCDR2 comprising an amino acid sequence that differs by no more than 1, 2, or 3 amino acid residues from, or has at least 85, 90, 95, 99 or 100% homology with, the amino acid sequence of the LCDR2 of antibody 430; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 430.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 440; an HCDR2 comprising an amino acid sequence that differs by no more than 1, 2, or 3 amino acid residues from, or has at least 85, 90, 95, 99 or 100% homology with, the amino acid sequence of the HCDR2 of antibody 440; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 440, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 440; an LCDR2 comprising an amino acid sequence that differs by no more than 1, 2, or 3 amino acid residues from, or has at least 85, 90, 95, 99 or 100% homology with, the amino acid sequence of the LCDR2 of antibody 440; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 440.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 453; an HCDR2 comprising an amino acid sequence that differs by no more than 1, 2, or 3 amino acid residues from, or has at least 85, 90, 95, 99 or 100% homology with, the amino acid sequence of the HCDR2 of antibody 453; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 453, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 453; an LCDR2 comprising an amino acid sequence that differs by no more than 1, 2, or 3 amino acid residues from, or has at least 85, 90, 95, 99 or 100% homology with, the amino acid sequence of the LCDR2 of antibody 453; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 453.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 454; an HCDR2 comprising an amino acid sequence that differs by no more than 1, 2, or 3 amino acid residues from, or has at least 85, 90, 95, 99 or 100% homology with, the amino acid sequence of the HCDR2 of antibody 454; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 454, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 454; an LCDR2 comprising an amino acid sequence that differs by no more than 1, 2, or 3 amino acid residues from, or has at least 85, 90, 95, 99 or 100% homology with, the amino acid sequence of the LCDR2 of antibody 454; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 454.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 465; an HCDR2 comprising an amino acid sequence that differs by no more than 1, 2, or 3 amino acid residues from, or has at least 85, 90, 95, 99 or 100% homology with, the amino acid sequence of the HCDR2 of antibody 465; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 465, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 465; an LCDR2 comprising an amino acid sequence that differs by no more than 1, 2, or 3 amino acid residues from, or has at least 85, 90, 95, 99 or 100% homology with, the amino acid sequence of the LCDR2 of antibody 465; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 465.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 475; an HCDR2 comprising an amino acid sequence that differs by no more than 1, 2, or 3 amino acid residues from, or has at least 85, 90, 95, 99 or 100% homology with, the amino acid sequence of the HCDR2 of antibody 475; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 475, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 475; an LCDR2 comprising an amino acid sequence that differs by no more than 1, 2, or 3 amino acid residues from, or has at least 85, 90, 95, 99 or 100% homology with, the amino acid sequence of the LCDR2 of antibody 475; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 475.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 507; an HCDR2 comprising an amino acid sequence that differs by no more than 1, 2, or 3 amino acid residues from, or has at least 85, 90, 95, 99 or 100% homology with, the amino acid sequence of the HCDR2 of antibody 507; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 507, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 507; an LCDR2 comprising an amino acid sequence that differs by no more than 1, 2, or 3 amino acid residues from, or has at least 85, 90, 95, 99 or 100% homology with, the amino acid sequence of the LCDR2 of antibody 507; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 507.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 510; an HCDR2 comprising an amino acid sequence that differs by no more than 1, 2, or 3 amino acid residues from, or has at least 85, 90, 95, 99 or 100% homology with, the amino acid sequence of the HCDR2 of antibody 510; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 510, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 510; an LCDR2 comprising an amino acid sequence that differs by no more than 1, 2, or 3 amino acid residues from, or has at least 85, 90, 95, 99 or 100% homology with, the amino acid sequence of the LCDR2 of antibody 510; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 510.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 511; an HCDR2 comprising an amino acid sequence that differs by no more than 1, 2, or 3 amino acid residues from, or has at least 85, 90, 95, 99 or 100% homology with, the amino acid sequence of the HCDR2 of antibody 511; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 511, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 511; an LCDR2 comprising an amino acid sequence that differs by no more than 1, 2, or 3 amino acid residues from, or has at least 85, 90, 95, 99 or 100% homology with, the amino acid sequence of the LCDR2 of antibody 511; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 511.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 518; an HCDR2 comprising an amino acid sequence that differs by no more than 1, 2, or 3 amino acid residues from, or has at least 85, 90, 95, 99 or 100% homology with, the amino acid sequence of the HCDR2 of antibody 518; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 518, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 518; an LCDR2 comprising an amino acid sequence that differs by no more than 1, 2, or 3 amino acid residues from, or has at least 85, 90, 95, 99 or 100% homology with, the amino acid sequence of the LCDR2 of antibody 518; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 518.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 528; an HCDR2 comprising an amino acid sequence that differs by no more than 1, 2, or 3 amino acid residues from, or has at least 85, 90, 95, 99 or 100% homology with, the amino acid sequence of the HCDR2 of antibody 528; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 528, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 528; an LCDR2 comprising an amino acid sequence that differs by no more than 1, 2, or 3 amino acid residues from, or has at least 85, 90, 95, 99 or 100% homology with, the amino acid sequence of the LCDR2 of antibody 528; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 528.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 541; an HCDR2 comprising an amino acid sequence that differs by no more than 1, 2, or 3 amino acid residues from, or has at least 85, 90, 95, 99 or 100% homology with, the amino acid sequence of the HCDR2 of antibody 541; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 541, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 541; an LCDR2 comprising an amino acid sequence that differs by no more than 1, 2, or 3 amino acid residues from, or has at least 85, 90, 95, 99 or 100% homology with, the amino acid sequence of the LCDR2 of antibody 541; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 541.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 547; an HCDR2 comprising an amino acid sequence that differs by no more than 1, 2, or 3 amino acid residues from, or has at least 85, 90, 95, 99 or 100% homology with, the amino acid sequence of the HCDR2 of antibody 547; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 547, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 547; an LCDR2 comprising an amino acid sequence that differs by no more than 1, 2, or 3 amino acid residues from, or has at least 85, 90, 95, 99 or 100% homology with, the amino acid sequence of the LCDR2 of antibody 547; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 547.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 549; an HCDR2 comprising an amino acid sequence that differs by no more than 1, 2, or 3 amino acid residues from, or has at least 85, 90, 95, 99 or 100% homology with, the amino acid sequence of the HCDR2 of antibody 549; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 549, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 549; an LCDR2 comprising an amino acid sequence that differs by no more than 1, 2, or 3 amino acid residues from, or has at least 85, 90, 95, 99 or 100% homology with, the amino acid sequence of the LCDR2 of antibody 549; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 549.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 550; an HCDR2 comprising an amino acid sequence that differs by no more than 1, 2, or 3 amino acid residues from, or has at least 85, 90, 95, 99 or 100% homology with, the amino acid sequence of the HCDR2 of antibody 550; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 550, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 550; an LCDR2 comprising an amino acid sequence that differs by no more than 1, 2, or 3 amino acid residues from, or has at least 85, 90, 95, 99 or 100% homology with, the amino acid sequence of the LCDR2 of antibody 550; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 550.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 553; an HCDR2 comprising an amino acid sequence that differs by no more than 1, 2, or 3 amino acid residues from, or has at least 85, 90, 95, 99 or 100% homology with, the amino acid sequence of the HCDR2 of antibody 553; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 553, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 553; an LCDR2 comprising an amino acid sequence that differs by no more than 1, 2, or 3 amino acid residues from, or has at least 85, 90, 95, 99 or 100% homology with, the amino acid sequence of the LCDR2 of antibody 553; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 553.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 556; an HCDR2 comprising an amino acid sequence that differs by no more than 1, 2, or 3 amino acid residues from, or has at least 85, 90, 95, 99 or 100% homology with, the amino acid sequence of the HCDR2 of antibody 556; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 556, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 556; an LCDR2 comprising an amino acid sequence that differs by no more than 1, 2, or 3 amino acid residues from, or has at least 85, 90, 95, 99 or 100% homology with, the amino acid sequence of the LCDR2 of antibody 556; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 556.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 567; an HCDR2 comprising an amino acid sequence that differs by no more than 1, 2, or 3 amino acid residues from, or has at least 85, 90, 95, 99 or 100% homology with, the amino acid sequence of the HCDR2 of antibody 567; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 567, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 567; an LCDR2 comprising an amino acid sequence that differs by no more than 1, 2, or 3 amino acid residues from, or has at least 85, 90, 95, 99 or 100% homology with, the amino acid sequence of the LCDR2 of antibody 567; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 567.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 568; an HCDR2 comprising an amino acid sequence that differs by no more than 1, 2, or 3 amino acid residues from, or has at least 85, 90, 95, 99 or 100% homology with, the amino acid sequence of the HCDR2 of antibody 568; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 568, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 568; an LCDR2 comprising an amino acid sequence that differs by no more than 1, 2, or 3 amino acid residues from, or has at least 85, 90, 95, 99 or 100% homology with, the amino acid sequence of the LCDR2 of antibody 568; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 568.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 570; an HCDR2 comprising an amino acid sequence that differs by no more than 1, 2, or 3 amino acid residues from, or has at least 85, 90, 95, 99 or 100% homology with, the amino acid sequence of the HCDR2 of antibody 570; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 570, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 570; an LCDR2 comprising an amino acid sequence that differs by no more than 1, 2, or 3 amino acid residues from, or has at least 85, 90, 95, 99 or 100% homology with, the amino acid sequence of the LCDR2 of antibody 570; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 570.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 573; an HCDR2 comprising an amino acid sequence that differs by no more than 1, 2, or 3 amino acid residues from, or has at least 85, 90, 95, 99 or 100% homology with, the amino acid sequence of the HCDR2 of antibody 573; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 573, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 573; an LCDR2 comprising an amino acid sequence that differs by no more than 1, 2, or 3 amino acid residues from, or has at least 85, 90, 95, 99 or 100% homology with, the amino acid sequence of the LCDR2 of antibody 573; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 573.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 583; an HCDR2 comprising an amino acid sequence that differs by no more than 1, 2, or 3 amino acid residues from, or has at least 85, 90, 95, 99 or 100% homology with, the amino acid sequence of the HCDR2 of antibody 583; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 583, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 583; an LCDR2 comprising an amino acid sequence that differs by no more than 1, 2, or 3 amino acid residues from, or has at least 85, 90, 95, 99 or 100% homology with, the amino acid sequence of the LCDR2 of antibody 583; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 583.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 584; an HCDR2 comprising an amino acid sequence that differs by no more than 1, 2, or 3 amino acid residues from, or has at least 85, 90, 95, 99 or 100% homology with, the amino acid sequence of the HCDR2 of antibody 584; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 584, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 584; an LCDR2 comprising an amino acid sequence that differs by no more than 1, 2, or 3 amino acid residues from, or has at least 85, 90, 95, 99 or 100% homology with, the amino acid sequence of the LCDR2 of antibody 584; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 584.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 585; an HCDR2 comprising an amino acid sequence that differs by no more than 1, 2, or 3 amino acid residues from, or has at least 85, 90, 95, 99 or 100% homology with, the amino acid sequence of the HCDR2 of antibody 585; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 585, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 585; an LCDR2 comprising an amino acid sequence that differs by no more than 1, 2, or 3 amino acid residues from, or has at least 85, 90, 95, 99 or 100% homology with, the amino acid sequence of the LCDR2 of antibody 585; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 585.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 586; an HCDR2 comprising an amino acid sequence that differs by no more than 1, 2, or 3 amino acid residues from, or has at least 85, 90, 95, 99 or 100% homology with, the amino acid sequence of the HCDR2 of antibody 586; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 586, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 586; an LCDR2 comprising an amino acid sequence that differs by no more than 1, 2, or 3 amino acid residues from, or has at least 85, 90, 95, 99 or 100% homology with, the amino acid sequence of the LCDR2 of antibody 586; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 586.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 588; an HCDR2 comprising an amino acid sequence that differs by no more than 1, 2, or 3 amino acid residues from, or has at least 85, 90, 95, 99 or 100% homology with, the amino acid sequence of the HCDR2 of antibody 588; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 588, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 588; an LCDR2 comprising an amino acid sequence that differs by no more than 1, 2, or 3 amino acid residues from, or has at least 85, 90, 95, 99 or 100% homology with, the amino acid sequence of the LCDR2 of antibody 588; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 588.

In an embodiment, the antibody molecule comprises: (i) a VH comprising one, two, or all of the following: an HCDR1 comprising an amino acid sequence that differs by no more than 1, 2, or 3 amino acid residues from, or has at least 85, 90, 95, 99 or 100% homology with, the amino acid sequence of the HCDR1 of antibody 592; an HCDR2 comprising an amino acid sequence that differs by no more than 1, 2, or 3 amino acid residues from, or has at least 85, 90, 95, 99 or 100% homology with, the amino acid sequence of the HCDR2 of antibody 592; or an HCDR3 comprising an amino acid sequence that differs by no more than 1, 2, or 3 amino acid residues from, or has at least 85, 90, 95, 99 or 100% homology with, the amino acid sequence of the HCDR3 of antibody 592, and (ii) a VL comprising one, two, or all of the following: an LCDR1 comprising an amino acid sequence that differs by no more than 1, 2, or 3 amino acid residues from, or has at least 85, 90, 95, 99 or 100% homology with, the amino acid sequence of the LCDR1 of antibody 592; an LCDR2 comprising an amino acid sequence that differs by no more than 1, 2, or 3 amino acid residues from, or has at least 85, 90, 95, 99 or 100% homology with, the amino acid sequence of the LCDR2 of antibody 592; or an LCDR3 comprising an amino acid sequence that differs by no more than 1, 2, or 3 amino acid residues from, or has at least 85, 90, 95, 99 or 100% homology with, the amino acid sequence of the LCDR3 of antibody 592.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 11v2. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 11v2. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 11v2; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 11v2. In an embodiment the antibody molecule is antibody 11v2.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 322. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 322. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 322; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 322. In an embodiment the antibody molecule is antibody 322.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 329. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 329. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 329; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 329. In an embodiment the antibody molecule is antibody 329.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 330. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 330. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 330; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 330. In an embodiment the antibody molecule is antibody 330.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 336v2-1. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 336v2-1. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 336v2-1; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 336v2-1. In an embodiment the antibody molecule is antibody 336v2-1.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 402. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 402. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 402; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 402. In an embodiment the antibody molecule is antibody 402.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 429. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 429. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 429; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 429. In an embodiment the antibody molecule is antibody 429.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 430. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 430. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 430; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 430. In an embodiment the antibody molecule is antibody 430.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 440. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 440. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 440; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 440. In an embodiment the antibody molecule is antibody 440.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 453. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 453. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 453; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 453. In an embodiment the antibody molecule is antibody 453.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 454. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 454. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 454; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 454. In an embodiment the antibody molecule is antibody 454.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 465. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 465. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 465; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 465. In an embodiment the antibody molecule is antibody 465.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 475. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 475. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 475; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 475. In an embodiment the antibody molecule is antibody 475.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 507. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 507. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 507; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 507. In an embodiment the antibody molecule is antibody 507.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 510. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 510. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 510; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 510. In an embodiment the antibody molecule is antibody 510.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 511. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 511. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 511; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 511. In an embodiment the antibody molecule is antibody 511.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 518. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 518. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 518; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 518. In an embodiment the antibody molecule is antibody 518.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 528. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 528. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 528; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 528. In an embodiment the antibody molecule is antibody 528.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 541. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 541. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 541; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 541. In an embodiment the antibody molecule is antibody 541.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 547. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 547. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 547; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 547. In an embodiment the antibody molecule is antibody 547.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 549. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 549. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 549; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 549. In an embodiment the antibody molecule is antibody 549.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 550. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 550. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 550; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 550. In an embodiment the antibody molecule is antibody 550.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 553. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 553. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 553; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 553. In an embodiment the antibody molecule is antibody 553.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 556. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 556. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 556; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 556. In an embodiment the antibody molecule is antibody 556.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 568. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 568. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 568; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 568. In an embodiment the antibody molecule is antibody 568.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 570. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 570. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 570; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 570. In an embodiment the antibody molecule is antibody 570.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 573. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 573. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 573; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 573. In an embodiment the antibody molecule is antibody 573.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 583. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 583. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 583; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 583. In an embodiment the antibody molecule is antibody 583.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 584. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 584. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 584; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 584. In an embodiment the antibody molecule is antibody 584.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 585. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 585. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 585; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 585. In an embodiment the antibody molecule is antibody 585.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 586. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 586. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 586; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 586. In an embodiment the antibody molecule is antibody 586.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 588. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 588. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 588; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 588. In an embodiment the antibody molecule is antibody 588.

In an embodiment, the antibody molecule comprises a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 592. In an embodiment, the antibody molecule comprises a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 592. In an embodiment, the antibody molecule comprises: (i) a VH comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VH of antibody 592; and (ii) a VL comprising an amino acid sequence that differs by no more than 1, 2, 3, 4, 5, 6, 7, 8, 9, 10, 11, 12, 13, 14, or 15 amino acid residues from, or has at least 85, 90, 95, 96, 97, 98, 99, or 100% homology with, the amino acid sequence of the VL of antibody 592. In an embodiment the antibody molecule is antibody 592.

In an aspect, the disclosure features an anti-C5aR1 antibody molecule, which:
a) competes for binding to C5aR1 (e.g., human C5aR1) with an antibody molecule comprising the heavy chain complementary determining regions (HCDR1, HCDR2 and HCDR3) and the light chain complementary determining regions (LCDR1, LCDR2 and LCDR3) of any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C); or
b) binds, or substantially binds, to an epitope on C5aR1 (e.g., human C5aR1) that completely or partially overlaps with the epitope of an antibody molecule comprising the heavy chain complementary determining regions (HCDR1, HCDR2 and HCDR3) and the light chain complementary determining regions (LCDR1, LCDR2 and LCDR3) of any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C).

In an embodiment, the disclosure features an anti-C5aR1 antibody molecule, which:
a) competes for binding to C5aR1 (e.g., human C5aR1) with an antibody molecule comprising the heavy chain complementary determining regions (HCDR1, HCDR2 and HCDR3) and the light chain complementary determining regions (LCDR1, LCDR2 and LCDR3) of any of antibodies 11v2, 322, 329, 583, 66 and 336v2; or
b) binds, or substantially binds, to an epitope on C5aR1 (e.g., human C5aR1) that completely or partially overlaps with the epitope of an antibody molecule comprising the heavy chain complementary determining regions (HCDR1, HCDR2 and HCDR3) and the light chain complementary determining regions (LCDR1, LCDR2 and LCDR3) of any of antibodies 11v2, 322, 329, 583, 66 and 336v2.

In an embodiment, the anti-C5aR1 antibody molecule is a synthetic antibody molecule. In an embodiment, the anti-C5aR1 antibody molecule is an isolated antibody molecule. In an embodiment, the anti-C5aR1 antibody molecule is a human or humanized antibody molecule, e.g., comprising one or more framework regions derived from human framework germline sequence.

In an embodiment, the anti-C5aR1 antibody molecule competes for binding with two, three, four, five, six, seven, eight, nine, ten, or more of the antibody molecules that comprise the HCDR1, HCDR2, HCDR3, LCDR1, LCDR2, and LCDR3 of any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C).

In an embodiment, the anti-C5aR1 antibody molecule binds, or substantially binds, to an epitope that completely or partially overlaps with the epitopes of two, three, four, five, six, seven, eight, nine, ten, or more of the antibody molecules that comprise the HCDR1, HCDR2, HCDR3, LCDR1, LCDR2, and LCDR3 of any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C).

In an embodiment, the anti-C5aR1 antibody molecule is a monospecific or monoparatopic antibody molecule. In an embodiment, the anti-C5aR1 antibody molecule is a multispecific or multiparatopic (e.g., a bispecific or biparatopic) antibody molecule.

In an embodiment, the antibody molecule that comprises the HCDR1, HCDR2, HCDR3, LCDR1, LCDR2, and LCDR3 of any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C) molecule is a monospecific or monoparatopic antibody molecule. In an embodiment, the antibody molecule that comprises the HCDR1, HCDR2, HCDR3, LCDR1, LCDR2, and LCDR3 of any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C) is a multispecific or multiparatopic (e.g., a bispecific or biparatopic) antibody molecule.

In an embodiment, the antibody molecule that comprises the HCDR1, HCDR2, HCDR3, LCDR1, LCDR2, and LCDR3 of any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C) comprises a heavy chain variable region and a light chain variable region of any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C).

In an embodiment, the antibody molecule that comprises the HCDR1, HCDR2, HCDR3, LCDR1, LCDR2, and LCDR3 of any of antibodies 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C) is antibody 11v2, 322, 329, 330, 336v2-1, 402, 429, 430, 440, 453, 454, 465, 475, 507, 510, 511, 518, 528, 541, 547, 549, 550, 553, 556, 567, 568, 570, 573, 583, 584, 585, 586, 588, or 592 (e.g., as listed in Table 1C).

In an embodiment, the antibody molecule comprises a heavy chain variable region (VH) having an amino acid sequence described any of Tables 1A, 2A, or 3A. In an embodiment, the antibody molecule comprises a light chain variable region (VL) having an amino acid sequence described in any of Tables 1B, 2B, or 3B. In an embodiment, the antibody molecule comprises a heavy chain variable region (VH) having an amino acid sequence described in any of Tables 1A, 2A, or 3A and a light chain variable region (VL) having an amino acid sequence described in any of Tables 1B, 2B, or 3B.

In an embodiment, the anti-C5aR1 antibody molecule binds, or substantially binds, to C5aR1 (e.g., human C5aR1), at an $EC_{50}$ of 100 nM or less, e.g., 80 nM or less, 60 nM or less, 40 nM or less, 20 nM or less, 10 nM or less, 9 nM or less, 8 nM or less, 7 nM or less, 6 nM or less, 5 nM or less, 4 nM or less, 3 nM or less, 2 nM or less, 1 nM or less, 0.8 nM or less, 0.6 nM or less, 0.4 nM or less, 0.2 nM or less, 0.1 nM or less, 0.05 nM or less, 0.02 nM or less, 0.01 nM or less, 0.005 nM or less, 0.002 nM or less, or 0.001 nM or less, e.g., between 0.001 nM and 100 nM, e.g., between 0.001 nM and 50 nM, between 0.01 nM and 20 nM, between 0.1 nM and 20 nM, e.g., between 0.1 nM and 10 nM, between 0.5 nM and 5 nM, between 1 nM and 5 nM, between 0.001 nM and 0.1 nM, between 0.001 nM and 0.01 nM, between 0.001 nM and 0.005 nM, between 0.01 nM and 0.05 nM, or between 0.01 nM and 0.1 nM, e.g., as determined by a method described herein.

In an embodiment, the antibody molecule inhibits, or substantially inhibits, binding of C5aR1 (e.g., human C5aR1) to C5a (e.g., human C5a). In an embodiment, the antibody molecule inhibits, or substantially inhibits, binding of C5aR1 (e.g., human C5aR1) to C5a (e.g., human C5a), at an $EC_{50}$ of 100 nM or less, e.g., 80 nM or less, 60 nM or less, 40 nM or less, 20 nM or less, 10 nM or less, 9 nM or less, 8 nM or less, 7 nM or less, 6 nM or less, 5 nM or less, 4 nM or less, 3 nM or less, 2 nM or less, 1 nM or less, 0.8 nM or less, 0.6 nM or less, 0.4 nM or less, 0.2 nM or less, 0.1 nM or less, 0.05 nM or less, 0.02 nM or less, 0.01 nM or less, 0.005 nM or less, 0.002 nM or less, or 0.001 nM or less, e.g., between 0.001 nM and 100 nM, e.g., between 0.001 nM and 50 nM, between 0.01 nM and 20 nM, between 0.1 nM and 20 nM, e.g., between 0.1 nM and 10 nM, between 0.5 nM and 5 nM, between 1 nM and 5 nM, between 0.001 nM and 0.1 nM, between 0.001 nM and 0.01 nM, between 0.001 nM and 0.005 nM, between 0.01 nM and 0.05 nM, or between 0.01 nM and 0.1 nM, e.g., as determined by a method described herein.

In an embodiment, the anti-C5aR1 antibody molecule binds to one or more epitopes described herein. In an embodiment, the anti-C5aR1 antibody molecule binds, or substantially binds, to one or more, e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, or all, residues (e.g., consecutive residues) within a region of human C5aR1 Site I sequence, e.g., comprising SEQ ID NO: 1449 or 1452. In an embodiment, the anti-C5aR1 antibody molecule binds, or substantially binds, to one or more, e.g., 2, 3, 4, 5, 6, 7, 8, 9, 10, 11, 12, 13, 14, 15, 16, 17, 18, 19, 20, 21, 22, 23, 24, 25, or all, residues (e.g., consecutive residues) within a region of human C5aR1 Site II sequence, e.g., comprising any of SEQ ID NOs: 1450, 1453, 1454, or 1455. In an embodiment, the anti-C5aR1 antibody molecule binds, or substantially binds, to one or more, e.g., 2, 3, 4, 5, 6, 7, 8, 9, 10, 11, 12, 13, 14, 15, 16, 17, 18, 19, or all, residues (e.g., consecutive residues) within a core epitope region of human C5aR1 Site II sequence, e.g., comprising amino acids 1-20 of SEQ ID NO: 1450. In an embodiment, the anti-C5aR1 antibody molecule binds, or substantially binds, to one or more, e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, or all, residues (e.g., consecutive residues) within a region of human C5aR1 Site I sequence, e.g., comprising SEQ ID NO: 1449 or 1452; and one or more, e.g., 2, 3, 4, 5, 6, 7, 8, 9, 10, 11, 12, 13, 14, 15, 16, 17, 18, 19, 20, 21, 22, 23, 24, 25, or all, residues (e.g., consecutive residues) within a region of human C5aR1 Site II sequence, e.g., comprising any of SEQ ID NOs: 1450, 1453, 1454, or 1455. In an embodiment, the anti-C5aR1 antibody molecule binds, or substantially binds, to one or more, e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, or all, residues (e.g., consecutive residues) within a region of human C5aR1 Site I sequence, e.g., comprising SEQ ID NO: 1449 or 1452; and one or more, e.g., 2, 3, 4, 5, 6, 7, 8, 9, 10, 11, 12, 13, 14, 15, 16, 17, 18, 19, or all, residues (e.g., consecutive residues) within a core epitope region of human C5aR1 Site II sequence, e.g., comprising amino acids 1-20 of SEQ ID NO: 1450.

In an embodiment, the anti-C5aR1 antibody molecule binds, or substantially binds, to a linear epitope. In an embodiment, the anti-C5aR1 antibody molecule binds, or substantially binds, to a conformational epitope. In an embodiment, the anti-C5aR1 antibody molecule binds, or substantially binds, to two or more epitopes on C5aR1. In an embodiment, the anti-C5aR1 antibody molecule binds to two or more conformational epitopes. In an embodiment, the anti-C5aR1 antibody molecule binds, or substantially binds, to at least one linear epitope and at least one conformational epitope.

In an embodiment, the anti-C5aR1 antibody molecule is an IgG antibody molecule, e.g., comprising a heavy chain constant region of IgG, e.g., chosen from IgG1, IgG2 (e.g., IgG2a), IgG3, or IgG4, e.g., IgG2 or IgG4. In an embodiment, the anti-C5aR1 antibody molecule is an IgG1 antibody molecule. In another embodiment, the anti-C5aR1 antibody molecule is an IgG2 antibody molecule. In an embodiment, the anti-C5aR1 antibody molecule comprises a light chain constant region of kappa or lambda light chain.

In an embodiment, the anti-C5aR1 antibody molecule comprises two heavy chain variable regions and two light chain variable regions. In an embodiment, the anti-C5aR1 antibody molecule comprises a Fab, F(ab')2, Fv, Fd, or a single chain Fv fragment (scFv).

In an embodiment, the anti-C5aR1 antibody molecule comprises an Fc region. In an embodiment, the Fc region comprises one or more mutations described in International Publication No. WO 2018/052556, U.S. Application Publication No. US 2018/0037634, Booth et al., MAbs. 2018; 10(7): 1098-1110, the contents of the aforesaid publications are incorporated by reference in their entirety.

In some embodiments, the monospecific antibody capable of binding to C5aR1, wherein the antibody inhibits Gα signaling.

In some embodiments, the monospecific antibody capable of binding to C5aR1, wherein the antibody inhibits neutrophil chemotaxis.

In some embodiments, the monospecific antibody capable of binding to C5aR1, inhibits calcium release.

In an embodiment, the monospecific antibody capable of binding to C5aR1, but not to C5aR2 or other GPCRs.

In an embodiment, the monospecific antibody capable of binding one or more amino acid residues of C5aR1 at Site I (SEQ ID NO: 1449 or SEQ ID NO: 1452) or one or more amino acid residues of C5aR1 at Site II (SEQ ID NO: 1450). In some embodiments, the monospecific antibody is capable of binding C5aR1 at Site II (SEQ ID NO: 1450).

In an embodiment, the monospecific antibody binding C5aR1, can compete with an antibody binding to C5aR1 at Site I (SEQ ID NO: 1449 or SEQ ID NO: 1452) or at Site II (SEQ ID NO: 1450).

In some embodiments the monospecific antibody binding C5aR1 binds one or more of amino acid residues T8 (threonine 8), D10 (aspartate 10), Y11 (tyrosine 11), Y14 (tyrosine 14) and/or D15 (aspartate 15).

In some embodiments the monospecific antibody binding C5aR1 binds to amino acid residues R175-G189 in SEQ ID NO: 1448.

In some embodiments the monospecific antibody binding C5aR1 binds to amino acid residues E180-P183 in SEQ ID NO: 1448.

In some embodiments the monospecific antibody binding C5aR1 binds to amino acid residues E180-P184 in SEQ ID NO: 1448.

In some embodiments the monospecific antibody binding C5aR1 binds to amino acid residues E178-P183 in SEQ ID NO: 1448.

Multispecific and Multiparatopic Antibody Molecules

Without wishing to be bound by theory, it is believed that in some embodiments, C5a binds to Site I and Site II of C5aR1. Antibody molecules binding to these sites should therefore cause orthosteric inhibition dependent on antibody affinity and, possibly, not on the antibody valency. In an embodiment, a cocktail of site I and II antibodies or a biparatopic antibody induces C5aR1 clustering. Such clustering can enhance potency of biparatopic antibodies (or a combination of site I+site II antibodies). In an embodiment, use of site I/site II combination or biparatopic antibodies can result in one or more of the following: receptor clustering (analogous to multimeric antigen), which could result in a slower off rate that translates to longer residence time and more potent and potentially complete or total inhibition of C5a binding; antibody mediated C5aR1 clustering, which could lead to internalization of receptors and making them unavailable for signaling, and/or C5aR1 clustering induced signal attenuation.

Without wishing to be bound by theory, it is believed that in some embodiments, a combination of site I and site II antibodies or a biparatopic antibody that bind to both Site I and Site II can theoretically form a lattice or large cluster of C5aR1 (FIG. 1). In an embodiment, an antibody mediated GPCR cluster can comprise GPCR molecules at the most 120 Å apart (e.g., the maximum distance between the two Fab domains of an IgG1). In an embodiment, effector proteins such as adenyl cyclase and ion channels are excluded from this GPCR cluster/raft. In an embodiment, effector proteins are anchored to the membrane through their lipid moiety.

Without wishing to be bound by theory, it is believed that in some embodiments, antibody-bound C5aR1 molecules that participate in clustering are inactive; however, if a Site II is exposed due to dissociation of the bound antibody molecule, it can, in some instances, facilitate the binding of agonist and get activated. In such an event, migration of a complex from outside the raft to the activated GPCR may be considerably slowed, thus reducing the GPCR signaling rate. On the other hand, a molecule that is present inside the cluster as an inclusion may be able to efficiently bind to the activated GPCR molecule. Upon activation, the molecules may migrate to their respective effector molecules outside the raft to cause signal cascade; this slow migration is contemplated to reduce the GPCR signaling rate. Thus, the antibody molecule-mediated GPCR clustering/raft may hinder efficient migration of the G-proteins between the activated GPCR and the effector molecules, resulting in signal attenuation. This signal attenuation can, in some instances, be independent of the antibody molecule's ability to inhibit the receptor molecule.

The antibody molecules described herein can, in some instances, be multispecific or multiparatopic antibody molecules.

In an embodiment, the antibody molecule is a multispecific or multiparatopic antibody molecule, e.g., it comprises a plurality of immunoglobulin variable region sequences, wherein a first immunoglobulin variable region sequence of the plurality has binding specificity for a first epitope and a second immunoglobulin variable region sequence of the plurality has binding specificity for a second epitope. In an embodiment, the first and second epitopes are on the same antigen, e.g., the same protein (or subunit of a multimeric protein). In an embodiment, the first and second epitopes overlap. In an embodiment, the first and second epitopes do not overlap. In an embodiment, the first and second epitopes are on different antigens, e.g., different proteins (or different subunits of a multimeric protein). In an embodiment, the first and second epitopes are on different molecules, e.g., different molecules of the same antigen. In an embodiment, a multispecific or multiparatopic antibody molecule comprises a third, fourth or fifth immunoglobulin variable region. In an embodiment, a multispecific or multiparatopic antibody molecule is a bispecific or biparatopic antibody molecule, a trispecific or triparatopic antibody molecule, or tetraspecific or tetraparatopic antibody molecule.

In an embodiment, the multispecific or multiparatopic antibody molecule is a bispecific or biparatopic antibody molecule. A bispecific or biparatopic antibody has specificity for no more than two antigens or epitopes. A bispecific or biparatopic antibody molecule is typically characterized by a first immunoglobulin variable region sequence which has binding specificity for a first epitope and a second immunoglobulin variable region sequence that has binding specificity for a second epitope. In an embodiment, the first and second epitopes are on the same antigen, e.g., the same protein (or subunit of a multimeric protein). In an embodiment, the first and second epitopes overlap. In an embodiment, the first and second epitopes do not overlap. In an embodiment, the first and second epitopes are on different antigens, e.g., the different proteins (or different subunits of a multimeric protein). In an embodiment, the first and second epitopes are on different molecules, e.g., different molecules of the same antigen. In an embodiment, a bispecific or biparatopic antibody molecule comprises a heavy chain variable region sequence and a light chain variable region sequence which have binding specificity for a first epitope and a heavy chain variable region sequence and a light chain variable region sequence which have binding specificity for a second epitope. In an embodiment, a bispecific or biparatopic antibody molecule comprises a half antibody having binding specificity for a first epitope and a half antibody having binding specificity for a second epitope. In an embodiment, a bispecific or biparatopic antibody molecule comprises a half antibody, or fragment thereof, having binding specificity for a first epitope and a half antibody, or fragment thereof, having binding specificity for a second epitope. In an embodiment, a bispecific or biparatopic antibody molecule comprises a scFv, or fragment thereof, have binding specificity for a first epitope and a scFv, or fragment thereof, have binding specificity for a second epitope. In an embodiment the first epitope is located on C5aR1 (e.g., Site I, e.g., comprising an N-terminal region as described herein) and the second epitope is located on C5aR1 (e.g., Site II, e.g., comprising an ECL1, ECL2, and/or ECL3, as described herein).

In an embodiment, the antibody molecule is multispecific (e.g., bispecific or trispecific). In an embodiment, the antibody molecule binds to C5aR1 (e.g., human C5aR1) and to one or more additional molecules. In an embodiment, the antibody molecule is multiparatopic (e.g., biparatopic). In an embodiment, the antibody molecule binds to two or more distinct epitopes on C5aR1 (e.g., human C5aR1). In an embodiment, the antibody is a biparatopic antibody that binds to Site I and Site II of C5aR1 (e.g., human C5aR1).

In an embodiment, the antibody molecule is a biparatopic antibody molecule capable of simultaneously binding to Site I and Site II of C5aR1 (e.g., human C5aR1). Such a biparatopic antibody molecule can, in an embodiment, exhibit higher affinity (e.g., 2, 3, 4, 5, 6, 7, 8, 9, 10, 15, 20, 25, 30, 40, 50, 60, 70, 80, 90, 100, 500, or 1000-fold higher affinity) and/or higher avidity (e.g., 2, 3, 4, 5, 6, 7, 8, 9, 10, 15, 20, 25, 30, 40, 50, 60, 70, 80, 90, 100, 500, or 1000-fold higher avidity) for C5aR1 (e.g., human C5aR1) compared to a monoparatopic antibody molecule.

In an embodiment, the biparatopic antibodies are orthosteric inhibitors, e.g., they compete with C5a for binding to C5aR1, and the binding of these antibodies to C5aR1 inhibit C5a binding and C5a mediated signaling. Biparatopic antibodies against Site I and Site II (and combination of Site I and Site II antibodies) may, in an embodiment, be able to engage with both sites on C5aR1 involved in C5a binding and therefore compete more effectively with C5a even in the presence of higher concentrations of C5a.

The antibody molecules described herein can be a multispecific or multiparatopic antibody molecule. In an embodiment, the antibody molecule binds, or substantially binds, to one or more, e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, or all, residues (e.g., consecutive residues) within a region of human C5aR1 Site I sequence, e.g., comprising SEQ ID NO: 1449 or 1452; and one or more, e.g., 2, 3, 4, 5, 6, 7, 8, 9, 10, 11, 12, 13, 14, 15, 16, 17, 18, 19, 20, 21, 22, 23, 24, 25, or all, residues (e.g., consecutive residues) within a region of human C5aR1 Site II sequence, e.g., comprising any of SEQ ID NOs: 1450, 1453, 1454, or 1455. In an embodiment, the antibody molecule binds, or substantially binds, to one or more, e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, or all, residues (e.g., consecutive residues) within a region of human C5aR1 Site I sequence, e.g., comprising SEQ ID NO: 1449 or 1452; and one or more, e.g., 2, 3, 4, 5, 6, 7, 8, 9, 10, 11, 12, 13, 14, 15, 16, 17, 18, 19, or more, residues (e.g., consecutive residues) within a core epitope region of human C5aR1 Site II sequence, e.g., comprising amino acids 1-20 of SEQ ID NO: 1450.

The multispecific or multiparatopic antibody molecules described herein (e.g., bispecific or biparatopic antibody molecules described herein) can be derived from monospecific or monoparatopic antibody molecules described herein. For example, biparatopic scFv-Fc molecules can be produced with knob-hole technology (e.g., including hole mutations: Y349C, T366S, L368A, Y407V; knob mutations: S354C, T366W).

In some embodiments, the multispecific or biparatopic antibody capable of binding to C5aR1, wherein the antibody inhibits Gα signaling.

In some embodiments, the multispecific or biparatopic antibody capable of binding to C5aR1, wherein the antibody inhibits neutrophil chemotaxis.

In some embodiments, the multispecific or biparatopic antibody capable of binding to C5aR1, inhibits calcium release.

In an embodiment, the multispecific or biparatopic antibody capable of binding to C5aR1, but not to C5aR2 or other GPCRs.

Animal Models

The antibody molecules described herein can be evaluated in vivo, e.g., using various animal models. For example, an animal model can be used to test the efficacy of an antibody molecule described herein in inhibiting C5aR1 and/or in treating or preventing a disorder described herein, e.g., a C5aR1-associated disorder, e.g., ANCA-vasculitis. Animal models can also be used, e.g., to investigate for side effects, measure concentrations of antibody molecules in situ, demonstrate correlations between an C5aR1 function and a disorder described herein (e.g., ANCA-vasculitis).

Exemplary animal models for the disorders described herein, e.g., a C5aR1-associated disorder, e.g., ANCA-vasculitis, are known in the art, e.g., as described in Salama and Little, *Curr Opin Rheumatol*. 2012; 24(1): 1-7; Coughlan et al., *Clin Exp Immunol*. 2012; 169(3): 229-237; and Hutton et al., *Semin Nephrol*. 2017; 37(5): 418-435. Exemplary types of animals that can be used to evaluate the antibody molecules described herein include, but are not limited to, mice, rats, rabbits, guinea pigs, and monkeys.

Pharmaceutical Compositions and Kits

In some aspects, this disclosure provides compositions, e.g., pharmaceutically acceptable compositions, which include an antibody molecule described herein, formulated together with a pharmaceutically acceptable carrier.

As used herein, "pharmaceutically acceptable carrier" includes any and all solvents, dispersion media, isotonic and absorption delaying agents, and the like that are physiologically compatible. The carrier can be suitable for intravenous, intramuscular, subcutaneous, parenteral, rectal, spinal or epidermal administration (e.g., by injection or infusion). In certain embodiments, less than about 5%, e.g., less than about 4%, 3%, 2%, or 1% of the antibody molecules in the pharmaceutical composition are present as aggregates. In other embodiments, at least about 95%, e.g., at least about 96%, 97%, 98%, 98.5%, 99%, 99.5%, 99.8%, or more of the antibody molecules in the pharmaceutical composition are present as monomers. In an embodiment, the level of aggregates or monomers is determined by chromatography, e.g., high performance size exclusion chromatography (HP-SEC).

The compositions set out herein may be in a variety of forms. These include, for example, liquid, semi-solid and solid dosage forms, such as liquid solutions (e.g., injectable and infusible solutions), dispersions or suspensions, liposomes, and suppositories. A suitable form depends on the intended mode of administration and therapeutic application. Typical suitable compositions are in the form of injectable or infusible solutions. One suitable mode of administration is parenteral (e.g., intravenous, subcutaneous, intraperitoneal, intramuscular). In an embodiment, the antibody molecule is administered by intravenous infusion or injection. In certain embodiments, the antibody is administered by intramuscular or subcutaneous injection.

The phrases "parenteral administration" and "administered parenterally" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

Therapeutic compositions typically should be sterile and stable under the conditions of manufacture and storage. The composition can be formulated as a solution, microemulsion, dispersion, liposome, or other ordered structure suitable to high antibody concentration. Sterile injectable solutions can be prepared by incorporating the active compound (i.e., antibody or antibody portion) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

The antibody molecules described herein can be administered by a variety of methods. Several are known in the art, and for many therapeutic, prophylactic, or diagnostic applications, an appropriate route/mode of administration is intravenous injection or infusion. For example, the antibody molecules can be administered by intravenous infusion at a rate of less than 10 mg/min; preferably less than or equal to 5 mg/min to reach a dose of about 1 to 100 mg/m$^2$, preferably about 5 to 50 mg/m$^2$, about 7 to 25 mg/m$^2$ and more preferably, about 10 mg/m$^2$. As will be appreciated by the skilled artisan, the route and/or mode of administration will vary depending upon the desired results. In certain embodiments, the active compound may be prepared with a carrier that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., *Sustained and Controlled Release Drug Delivery Systems*, J. R. Robinson, ed., Marcel Dekker, Inc., New York, 1978.

In certain embodiments, an antibody molecule can be orally administered, for example, with an inert diluent or an assimilable edible carrier. The antibody molecule (and other ingredients, if desired) may also be enclosed in a hard or soft shell gelatin capsule, compressed into tablets, or incorporated directly into the subject's diet. For oral therapeutic administration, the antibody molecule may be incorporated with excipients and used in the form of ingestible tablets, buccal tablets, troches, capsules, elixirs, suspensions, syrups, wafers, and the like. To administer an antibody molecule by other than parenteral administration, it may be necessary to coat the compound with, or co-administer the compound with, a material to prevent its inactivation. Therapeutic, prophylactic, or diagnostic compositions can also be administered with medical devices, and several are known in the art.

Dosage regimens are adjusted to provide the desired response (e.g., a therapeutic, prophylactic, or diagnostic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms are dictated by and directly dependent on (a) the unique characteristics of the antibody molecule and the particular therapeutic, prophylactic, or diagnostic effect to be achieved, and (b) the limitations inherent in the art of compounding such an antibody molecule for the treatment of sensitivity in individuals.

An exemplary, non-limiting range for a therapeutically, prophylactically, or diagnostically effective amount of an antibody molecule is about 0.1-50 mg/kg body weight of a subject, e.g., about 0.1-30 mg/kg, e.g., about 1-30, 1-15, 1-10, 1-5, 5-10, or 1-3 mg/kg, e.g., about 1, 2, 3, 4, 5, 6, 7, 8, 9, 10, 15, 20, 30, 40, or 50 mg/kg. The antibody molecule can be administered by intravenous infusion at a rate of less than 10 mg/min, e.g., less than or equal to 5 mg/min to reach a dose of about 1 to 100 mg/m$^2$, e.g., about 5 to 50 mg/m$^2$, about 7 to 25 mg/m$^2$, e.g., about 10 mg/m$^2$. It is to be noted that dosage values may vary with the type and severity of the condition to be alleviated. It is to be further understood that for any particular subject, specific dosage regimens should be adjusted over time according to the individual need and the professional judgment of the person administering or supervising the administration of the compositions, and that dosage ranges set forth herein are exemplary only and are not intended to limit the scope or practice of the claimed compositions.

The pharmaceutical compositions herein may include a "therapeutically effective amount," "prophylactically effective amount," or "diagnostically effectively amount" of an antibody molecule described herein.

A "therapeutically effective amount" refers to an amount effective, at dosages and for periods of time necessary, to achieve the desired therapeutic result. A therapeutically effective amount of the antibody molecule may vary according to factors such as the disease state, age, sex, and weight of the individual, and the ability of the antibody or antibody portion to elicit a desired response in the individual. A therapeutically effective amount is also one in which any toxic or detrimental effect of the antibody molecule is outweighed by the therapeutically beneficial effects. A "therapeutically effective dosage" typically inhibits a measurable parameter by at least about 20%, e.g., by at least about 40%, by at least about 60%, or by at least about 80% relative to untreated subjects. The measurable parameter may be, e.g., hematuria, colored urine, foamy urine, pain, swelling (edema) in the hands and feet, or high blood pressure. The ability of an antibody molecule to inhibit a measurable parameter can be evaluated in an animal model system predictive of efficacy in treating or preventing a C5aR1-associated disorder, e.g., ANCA-vasculitis. Alternatively, this property of a composition can be evaluated by examining the ability of the antibody molecule to inhibit C5aR1, e.g., by an in vitro assay.

A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

A "diagnostically effective amount" refers to an amount effective, at dosages and for periods of time necessary, to achieve the desired diagnostic result. Typically, a diagnostically effective amount is one in which a disorder, e.g., a disorder described herein, e.g., a C5aR1-associated disorder, e.g., ANCA-vasculitis, can be diagnosed in vitro, ex vivo, or in vivo.

Also within this disclosure is a kit that comprises an antibody molecule, described herein. The kit can include one or more other elements including: instructions for use; other reagents, e.g., a label, a therapeutic agent, or an agent useful for chelating, or otherwise coupling, an antibody molecule to a label or therapeutic agent, or a radioprotective composition; devices or other materials for preparing the antibody molecule for administration; pharmaceutically acceptable carriers; and devices or other materials for administration to a subject.

Nucleic Acids

The present disclosure also features nucleic acids comprising nucleotide sequences that encode the antibody molecules (e.g., heavy and light chain variable regions and CDRs of the antibody molecules), as described herein.

For example, the present disclosure features a first and second nucleic acid encoding heavy and light chain variable regions, respectively, of an antibody molecule chosen from one or more of the antibody molecules disclosed herein, e.g., an antibody molecule of Table 1C, or a portion of an antibody molecule, e.g., the variable regions of any of Tables 1A, 2A, 3A, 1B, 2B, or 3B. The nucleic acid can comprise a nucleotide sequence encoding any one of the amino acid sequences in the tables herein, or a sequence substantially identical thereto (e.g., a sequence at least about 85%, 90%, 95%, 99% or more identical thereto, or which differs by no more than 3, 6, 15, 30, or 45 nucleotides from the sequences shown in the tables herein).

In certain embodiments, the nucleic acid comprises a nucleotide sequence encoding at least one, two, or three CDRs from a heavy chain variable region having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions). In an embodiment, the nucleic acid comprises a nucleotide sequence encoding at least one, two, or three CDRs from a light chain variable region having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions). In an embodiment, the nucleic acid comprises a nucleotide sequence encoding at least one, two, three, four, five, or six CDRs from heavy and light chain variable regions having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions).

The nucleic acids disclosed herein include deoxyribonucleotides or ribonucleotides, or analogs thereof. The polynucleotide may be either single-stranded or double-stranded, and if single-stranded may be the coding strand or non-coding (antisense) strand. A polynucleotide may comprise modified nucleotides, such as methylated nucleotides and nucleotide analogs. The sequence of nucleotides may be interrupted by non-nucleotide components. A polynucleotide may be further modified after polymerization, such as by conjugation with a labeling component. The nucleic acid may be a recombinant polynucleotide, or a polynucleotide of genomic, cDNA, semisynthetic, or synthetic origin which either does not occur in nature or is linked to another polynucleotide in a non-natural arrangement.

In some aspects, the application features host cells and vectors containing the nucleic acids described herein. The nucleic acids may be present in a single vector or separate vectors present in the same host cell or separate host cell, as described in more detail below.

Vectors

Further provided herein are vectors that comprise nucleotide sequences encoding the antibody molecules (e.g., heavy and light chain variable regions and CDRs of the antibody molecules), as described herein.

In an embodiment, the vector comprises a nucleic acid described herein. For example, the vector can comprises a first and second nucleic acid encoding heavy and light chain variable regions, respectively, of an antibody molecule chosen from one or more of the antibody molecules disclosed herein, e.g., an antibody molecule of Table 1C, or a portion of an antibody molecule, e.g., the variable regions of any of Tables 1A, 2A, 3A, 1B, 2B, or 3B.

In certain embodiments, the vector comprises a nucleotide sequence encoding at least one, two, or three CDRs from a heavy chain variable region having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions). In an embodiment, the vector comprises a nucleotide sequence encoding at least one, two, or three CDRs from a light chain variable region having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions). In an embodiment, the vector comprises a nucleotide sequence encoding at least one, two, three, four, five, or six CDRs from heavy and light chain variable regions having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions).

The vectors include, but are not limited to, a virus, plasmid, cosmid, lambda phage or a yeast artificial chromosome (YAC). Numerous vector systems can be employed. For example, one class of vectors utilizes DNA elements which are derived from animal viruses such as, for example, bovine papilloma virus, polyoma virus, adenovirus, vaccinia virus, baculovirus, retroviruses (Rous Sarcoma Virus, MMTV or MOMLV) or SV40 virus. Another class of vectors utilizes RNA elements derived from RNA viruses such as Semliki Forest virus, Eastern Equine Encephalitis virus and Flaviviruses.

Additionally, cells which have stably integrated the DNA into their chromosomes may be selected by introducing one or more markers which allow for the selection of transfected host cells. The marker may provide, for example, prototropy to an auxotrophic host, biocide resistance (e.g., antibiotics), or resistance to heavy metals such as copper, or the like. The selectable marker gene can be either directly linked to the DNA sequences to be expressed or introduced into the same cell by cotransformation. Additional elements may also be needed for optimal synthesis of mRNA. These elements may include splice signals, as well as transcriptional promoters, enhancers, and termination signals.

Once the expression vector or DNA sequence containing the constructs has been prepared for expression, the expression vectors may be transfected or introduced into an appropriate host cell. Various techniques may be employed to achieve this, such as, for example, protoplast fusion, calcium phosphate precipitation, electroporation, retroviral transduction, viral transfection, gene gun, lipid-based transfection or other conventional techniques. In the case of protoplast fusion, the cells are grown in media and screened for the appropriate activity.

Methods and conditions for culturing the resulting transfected cells and for recovering the antibody molecule produced are known to those skilled in the art and may be varied or optimized depending upon the specific expression vector and mammalian host cell employed, based upon the present description.

Cells

The present disclosure also provides cells (e.g., host cells) comprising a nucleic acid encoding an antibody molecule as described herein. For example, the host cells may comprise a nucleic acid molecule having a nucleotide sequence encoding an amino acid sequence described in any of Tables 1A, 1B, 2A, 2B, 3A, or 3B, a sequence substantially homologous thereto (e.g., a sequence at least about 85%, 90%, 95%, 99% or more identical thereto, and/or capable of hybridizing under the stringency conditions described herein), or a portion of one of said nucleic acids.

In an embodiment, the host cells are genetically engineered to comprise nucleic acids encoding the antibody molecule described herein.

In certain embodiments, the host cells are genetically engineered by using an expression cassette. The phrase "expression cassette," refers to nucleotide sequences, which are capable of affecting expression of a gene in hosts compatible with such sequences. Such cassettes may include a promoter, an open reading frame with or without introns, and a termination signal. Additional factors necessary or helpful in effecting expression may also be used, such as, for example, an inducible promoter.

The disclosure also provides host cells comprising the vectors described herein.

The cell can be, but is not limited to, a eukaryotic cell, a bacterial cell, an insect cell, or a human cell. Suitable eukaryotic cells include, but are not limited to, Vero cells, HeLa cells, COS cells, CHO cells, HEK293 cells, BHK cells and MDCKII cells. Suitable insect cells include, but are not limited to, Sf9 cells. In an embodiment, the cell (e.g., host cell) is an isolated cell.

Uses of Antibody Molecules

The antibody molecules disclosed herein, as well as the pharmaceutical compositions disclosed herein, have in vitro, ex vivo, and in vivo therapeutic, prophylactic, and/or diagnostic utilities.

In an embodiment, the antibody molecule reduces (e.g., inhibits, blocks, or neutralizes) one or more biological activities of C5aR1. For example, these antibodies molecules can be administered to cells in culture, in vitro or ex vivo, or to a subject, e.g., a human subject, e.g., in vivo, to reduce (e.g., inhibits, blocks, or neutralizes) one or more biological activities of C5aR1. In an embodiment, the antibody molecule inhibits, or substantially inhibit, binding of C5aR1, e.g., human C5aR1, to C5a. In an embodiment, the antibody molecule reduces (e.g., inhibits, blocks, or neutralizes) chemotaxis priming In an embodiment, the antibody molecule reduces (e.g., inhibits, blocks, or neutralizes) neutrophil activation. In an embodiment, the antibody molecule reduces (e.g., inhibits, blocks, or neutralizes) endothelium injury associated with C5aR1 signaling. For example, the antibody molecules described herein can be used to reduce elevated complement activation or to treat or prevent a disorder associated with elevated complement activation.

In an embodiment, an antibody molecule targeting Site I or the N-terminus of C5aR1 (e.g., an antibody molecule described herein) is used. In an embodiment, an antibody molecule targeting Site II of C5aR1 (e.g., an antibody molecule described herein) is used. In an embodiment, a combination of an antibody molecule targeting Site I of C5aR1 (e.g., an antibody molecule described herein) and an antibody molecule targeting Site II (e.g., comprising ECL2) of C5aR1 (e.g., an antibody molecule described herein) is used. In an embodiment, a combination of an antibody molecule targeting Site I of C5aR1 (e.g., an antibody molecule described herein) and an antibody molecule targeting Site II (e.g., comprising ECL2) of C5aR1 (e.g., an antibody molecule described herein) achieves an additive or synergistic effect, e.g., on C5aR1 signaling. In an embodiment, an antibody molecule targeting Site I, and Site II (e.g., comprising ECL2) of C5aR1 (e.g., an antibody molecule described herein) is used. In an embodiment, an antibody molecule targeting Site I, and Site II (e.g., comprising ECL2) C5aR1 (e.g., an antibody molecule described herein) achieves an additive or synergistic effect, e.g., on C5aR1 signaling, e.g., compared to monovalent controls. Without wishing to be bound by theory, it is believed that in some embodiments, such a combination use, or use of a multi-specific or multiparatopic (e.g., bispecific or biparatopic) antibody molecules, can have certain gain of function due to a combination of valency and/or specificity, e.g., receptor clustering that promotes internalization or prevents G-protein binding and/or efficient migration of the G-proteins between the activated GPCR and the effector molecules.

Accordingly, in an aspect, the disclosure provides a method of treating, preventing, or diagnosing a disorder, e.g., a disorder described herein (e.g., a C5aR1-associated disorder, e.g., ANCA-vasculitis), in a subject, comprising administering to the subject an antibody molecule described herein, such that the disorder is treated, prevented, or diagnosed. For example, the disclosure provides a method comprising contacting the antibody molecule described herein with cells in culture, e.g. in vitro or ex vivo, or administering the antibody molecule described herein to a subject, e.g., in vivo, to treat, prevent, or diagnose a disorder (e.g., a C5aR1-associated disorder, e.g., ANCA-vasculitis).

As used herein, the term "subject" is intended to include human and non-human animals In an embodiment, the subject is a human subject, e.g., a human patient having a disorder described herein (e.g., a C5aR1-associated disorder, e.g., ANCA-vasculitis), or at risk of having a disorder described herein (e.g., a C5aR1-associated disorder, e.g., ANCA-vasculitis). The term "non-human animals" includes mammals and non-mammals, such as non-human primates. In an embodiment, the subject is a human. The methods and compositions described herein are suitable for treating human patients a disorder described herein (e.g., a C5aR1-associated disorder, e.g., ANCA-vasculitis). Patients having a disorder described herein (e.g., a C5aR1-associated disorder, e.g., ANCA-vasculitis) include those who have developed a disorder described herein (e.g., a C5aR1-associated disorder, e.g., ANCA-vasculitis) but are (at least temporarily) asymptomatic, patients who have exhibited a symptom of a disorder described herein (e.g., a C5aR1-associated disorder, e.g., ANCA-vasculitis), or patients having a disorder related to or associated with a disorder described herein (e.g., a C5aR1-associated disorder, e.g., ANCA-vasculitis).

Methods of Treating or Preventing Disorders

The antibody molecules described herein can be used to treat or prevent disorders associated with C5aR1 and/or C5 or symptoms thereof. Without wishing to be bound by theory, it is believed that in some embodiments, targeting the C5a/C5aR1 axis (e.g., by targeting the agonist precursor C5, the agonist C5a, or the receptor C5aR1) as described herein provides a useful approach to treat or prevent various disorders, e.g., to limit disease progression.

Exemplary disorders or conditions that can be treated or prevented by the antibody molecules described herein include, but are not limited to, a C5aR1-associated disorder or a C5-associated disorder. In an embodiment, the disorder is associated with neutrophil recruitment, activation, and/or NETosis. In an embodiment, the disorder is associated with complement system activation and/or coagulation system activation. In an embodiment, the disorder is associated with a C5aR-mediated inflammatory response. In an embodiment, the disorder is associated with monocyte chemoattractant protein-1 (MCP-1) and/or renal inflammation. In an embodiment, the disorder is associated with chemotaxis (e.g., chemotaxis priming) In an embodiment, the disorder is associated with endothelium injury.

In an embodiment, the exemplary disorders, for example, a C5aR1-associated disorder, can be treated using an antibody capable of binding one or more amino acid residues of C5aR1 at Site I (SEQ ID NO: 1449 or SEQ ID NO: 1452) or one or more amino acid residues of C5aR1 at Site II (SEQ ID NO: 1450). In some embodiments, the exemplary disorders, for example, a C5aR1-associated disorder, can be treated using an antibody capable of binding C5aR1 at Site II (SEQ ID NO: 1450).

In an embodiment, the exemplary disorders, for example, a C5aR1-associated disorder, can be treated using an antibody capable of competing with an antibody binding to C5aR1 at Site I (SEQ ID NO: 1449 or SEQ ID NO: 1452) or at Site II (SEQ ID NO: 1450).

In an embodiment, the exemplary disorders, for example, a C5aR1-associated disorder, can be treated using an antibody capable of binding to C5aR1, but not to C5aR2 or other GPCRs.

In an embodiment, the exemplary disorders, for example, a C5aR1-associated disorder, can be treated using an antibody capable of binding to C5aR1, comprising a heavy chain, light chain, HCDRs and LCDRs presented in Tables 1A, 1B, 2A, 2B, 3A and 3B.

In an embodiment, the exemplary disorders, for example, a C5aR1-associated disorder, can be treated using an antibody capable of binding to C5aR1, the antibody comprising the amino acid sequences AYAMS (SEQ ID NO: 1456), SISTGGNTY (SEQ ID NO: 1457), and GYQRFSGFAY (SEQ ID NO: 1458) or a variant thereof. In some embodiments, the antibody variant for the treatment of a C5aR1-associated disorder, comprises an amino acid sequence that differs by no more than 5, 4, 3, 2 or 1 amino acids from the amino acids of SEQ ID NO: 1456, SEQ ID NO: 1457 or SEQ ID NO: 1458. In some embodiments, the exemplary disorders, for example, a C5aR1-associated disorder, can be treated using an antibody capable of binding to C5aR1, comprises HCDRs, wherein the HCDRs comprise SEQ ID NOs: 1456, 1457 and/or 1458 are part of HCDR.

In some embodiments, the exemplary disorders, for example, a C5aR1-associated disorder, can be treated using an antibody capable of binding to C5aR1, the antibody comprising the amino acid sequences RSSQSLVHSNGNTYLN (SEQ ID NO: 1459), KVSNRLS (SEQ ID NO: 1460), and SQSTHVPYT (SEQ ID NO: 1461). In some embodiments, the antibody variant for the treatment of a C5aR1-associated disorder, comprises an amino acid sequence that differs by no more than 5, 4, 3, 2 or 1 amino acids from the amino acids of SEQ ID Nos: 1459, 1460 and/or 1461. In some embodiments, the antibody comprising SEQ ID NOs: 1459, 1460 and/or 1461, bind Site II defined by SEQ ID NO: 1450. In some embodiments, the exemplary disorders, for example, a C5aR1-associated disorder, can be treated using an antibody capable of binding to C5aR1, comprises HCDRs, wherein the HCDRs comprise SEQ ID NOs: 1459, 1460 and/or 1461 are part of HCDR.

In some embodiments, the exemplary disorders, for example, a C5aR1-associated disorder, can be treated using an antibody capable of binding to C5aR1, wherein the antibody binds C5aR1 with an affinity of 10 pM to 50 nM.

In some embodiments, the exemplary disorders, for example, a C5aR1-associated disorder, can be treated using an antibody capable of binding to C5aR1, wherein the antibody inhibits Gα signaling.

In some embodiments, the exemplary disorders, for example, a C5aR1-associated disorder, can be treated using an antibody capable of binding to C5aR1, wherein the antibody inhibits neutrophil chemotaxis.

In some embodiments, the exemplary disorders, for example, a C5aR1-associated disorder, can be treated using an antibody capable of binding to C5aR1, wherein the antibody inhibits calcium release.

In an embodiment, the exemplary disorders, for example, a C5aR1-associated disorder, can be treated using a combination of an antibody capable of binding to C5aR1, and an additional therapeutic or a second therapeutic. In some embodiments, the additional therapeutic for the treatment of a C5aR1 associated disease is a small molecule, such as, but not limited to avacopan.

In an embodiment, the exemplary disorders, for example, a C5aR1-associated disorder, can be treated using a multispecific or biparatopic antibody capable of binding one or more amino acid residues of C5aR1 at Site I (SEQ ID NO: 1449 or SEQ ID NO: 1452) and one or more amino acid residues of C5aR1 at Site II (SEQ ID NO: 1450).

In an embodiment, the exemplary disorders, for example, a C5aR1-associated disorder, can be treated using a multispecific or biparatopic antibody capable of competing with an antibody binding to C5aR1 at Site I (SEQ ID NO: 1449 or SEQ ID NO: 1452) and at Site II (SEQ ID NO: 1450).

In an embodiment, the exemplary disorders, for example, a C5aR1-associated disorder, can be treated using a multispecific or biparatopic antibody capable of binding to C5aR1, the antibody comprising the amino acid sequences AYAMS (SEQ ID NO: 1456), SISTGGNTY (SEQ ID NO: 1457), and GYQRFSGFAY (SEQ ID NO: 1458) or a variant thereof; and an antibody comprising the amino acid sequences RSSQSLVHSNGNTYLN (SEQ ID NO: 1459), KVSNRLS (SEQ ID NO: 1460), and SQSTHVPYT (SEQ ID NO: 1461) or a variant thereof. In some embodiments, the multispecific or biparatopic antibody variant for the treatment of a C5aR1-associated disorder, comprises an amino acid sequence that differs by no more than 5, 4, 3, 2 or 1 amino acids from the amino acids of SEQ ID Nos: 1459, 1460 and/or 1461. In some embodiments, the multispecific or biparatopic antibody variant for the treatment of a C5aR1-associated disorder, comprises an amino acid sequence that differs by no more than 5, 4, 3, 2 or 1 amino acids from the amino acids of SEQ ID NO: 1456, SEQ ID NO: 1457 or SEQ ID NO: 1458.

In an embodiment, the exemplary disorders, for example, a C5aR1-associated disorder, can be treated using a multispecific or biparatopic antibody capable of competing with an antibody binding to C5aR1 at Site I (SEQ ID NO: 1449 or SEQ ID NO: 1452) and at Site II (SEQ ID NO: 1450).

In some embodiments, the exemplary disorders, for example, a C5aR1-associated disorder, can be treated using a multispecific or biparatopic antibody capable of binding to C5aR1, wherein the antibody binds C5aR1 with an affinity of 10 pM to 50 nM.

In some embodiments, the exemplary disorders, for example, a C5aR1-associated disorder, can be treated using a multispecific or biparatopic antibody capable of binding to C5aR1, wherein the antibody inhibits Gα signaling.

In some embodiments, the exemplary disorders, for example, a C5aR1-associated disorder, can be treated using a multispecific or biparatopic antibody capable of binding to C5aR1, wherein the antibody inhibits neutrophil chemotaxis.

In an embodiment, the exemplary disorders, for example, a C5aR1-associated disorder, can be treated using a multispecific or biparatopic antibody capable of binding to C5aR1, but not to C5aR2 or other GPCRs.

In an embodiment, the exemplary disorders, for example, a C5aR1-associated disorder, can be treated using a combination of a multispecific or a biparatopic antibody capable of binding to C5aR1, and an additional therapeutic or a second therapeutic. In some embodiments, the additional therapeutic for the treatment of a C5aR1 associated disease is a small molecule, such as, but not limited to avacopan.

Exemplary disorders or conditions that can be treated or prevented by the antibody molecules described herein also include, but are not limited to, vasculitis (e.g., ANCA-vasculitis), an autoimmune disorder (e.g., rheumatoid arthritis or lupus), or cancer. In an embodiment, the disorder is associated with aberrant expression of C5aR1 or C5a. In an embodiment, the antibody molecule is used to treat a subject having a disorder described herein or is at risk of developing a disorder described herein. Exemplary disorders that can be treated with an antibody molecule described herein are listed, e.g., in Table 7. Table 7 also lists exemplary agents that can be combined with an antibody molecule described herein for treating such disorders.

TABLE 7

Exemplary disorders treatable with anti-C5aR1 antibody molecules

| Indication | Combination Agent(s) |
|---|---|
| ANCA-Vasculitis | Avacopan |
| C3 glomerulopathy/aHUS | Avacopan |
| IgA nephropathy | Avacopan |
| Hidradenitis Suppurativa | Avacopan, IFX-1 |
| Pyoderma gangrenosum | IFX-1 |
| Sepsis | IFX-1 |
| Rheumatoid arthritis | IPH5401, PMX53 |
| Osteoarthritis | PMX53 |
| Psoriasis | PMX53 |
| Age-related macular degeneration (AMD) | PMX53 |
| Graft versus host disease (GvHD) | ALXN-1007 |
| Anti-phospholipid syndrome | ALXN-1007 |
| Cancer | MOR210 (TJ210) + CKIs |
| Cancer | IPH5401 + CKIs |
| Amyotrophic lateral sclerosis (ALS) | |
| Huntington's disease | |
| Alzheimer's disease | |
| Neuropathic pain | |

Further examples of diseases and disorders that can be treated with an antibody molecule described herein are listed, for example, in Table 2 of Sadik et al. (*Semin. Immunol.* 37: 21-29 (2018); incorporated herein by reference in its entirety.

The antibody molecules described herein are typically administered at a frequency that keeps a therapeutically effective level of antibody molecules in the patient's system until the patient recovers. For example, the antibody molecules may be administered at a frequency that achieves a serum concentration sufficient for at least about 1, 2, 5, 10, 20, 30, or 40 antibody molecules to bind each C5aR1 molecule. In an embodiment, the antibody molecules are administered every 1, 2, 3, 4, 5, 6, or 7 days, every 1, 2, 3, 4, 5, or 6 weeks, or every 1, 2, 3, 4, 5, or 6 months.

Methods of administering various antibody molecules are known in the art and are described below. Suitable dosages of the antibody molecules used will depend on the age and weight of the subject and the particular drug used.

In an embodiment, the antibody molecule is administered to the subject (e.g., a human subject) intravenously. In an embodiment, the antibody molecule is administered to the subject at a dose between 0.1 mg/kg and 50 mg/kg, e.g., between 0.2 mg/kg and 25 mg/kg, between 0.5 mg/kg and 10 mg/kg, between 0.5 mg/kg and 5 mg/kg, between 0.5 mg/kg and 3 mg/kg, between 0.5 mg/kg and 2.5 mg/kg, between 0.5 mg/kg and 2 mg/kg, between 0.5 mg/kg and 1.5 mg/kg, between 0.5 mg/kg and 1 mg/kg, between 1 mg/kg and 1.5 mg/kg, between 1 mg/kg and 2 mg/kg, between 1 mg/kg and 2.5 mg/kg, between 1 mg/kg and 3 mg/kg, between 1 mg/kg and 2.5 mg/kg, or between 1 mg/kg and 5 mg/kg. In an embodiment, the antibody molecule is administered to the subject at a fixed dose between 10 mg and 1000 mg, e.g., between 10 mg and 500 mg, between 10 mg and 250 mg, between 10 mg and 150 mg, between 10 mg and 100 mg, between 10 mg and 50 mg, between 250 mg and 500 mg, between 150 mg and 500 mg, between 100 mg and 500 mg, between 50 mg and 500 mg, between 25 mg and 250 mg, between 50 mg and 150 mg, between 50 mg and 100 mg, between 100 mg and 150 mg. between 100 mg and 200 mg, or between 150 mg and 250 mg. In an embodiment, the antibody molecule is administered once a week, twice a week, once every two weeks, once every three weeks, once every four weeks, once every eight weeks, once a month, once every two months, or once every three months. In an embodiment, the antibody molecule is administered between 0.5 mg/kg and 3 mg/kg or between 50 mg and 150 mg, once a week, twice a week, once every two weeks, or once every four weeks.

The antibody molecules can be used by themselves or conjugated to a second agent, e.g., a bacterial agent, toxin, or protein, e.g., a second anti-C5aR1 antibody molecule. This method includes: administering the antibody molecule, alone or conjugated to a second agent, to a subject requiring such treatment. The antibody molecules can be used to deliver a variety of therapeutic agents, e.g., a toxin, or mixtures thereof.

Vasculitis

The antibody molecule described herein can be used to treat or prevent vasculitis (e.g., ANCA-vasculitis). Vasculitis is a group of disorders that destroy blood vessels by inflammation. Vasculitis is primarily caused by leukocyte migration and resultant damage. Exemplary types of vasculitis include, but are not limited to, ANCA-vasculitis, Henoch-Schönlein purpura, acute proliferative glomerulonephritis (e.g., post-streptococcal glomerulonephritis), microscopic polyarteritis (poly-angiitis), Wegener's granulomatosis, polyarteritis nodosa, ANCA-Vasculitis In an embodiment, the antibody molecule is used to treat or prevent anti-neutrophil cytoplasmic autoantibody (ANCA)-vasculitis (also known as antineutrophil cytoplasmic antibody-associated vasculitis or ANCA-associated vasculitis (AAV)).

ANCA-vasculitis is an autoimmune disease characterized by an immune response to either myeloperoxidase (MPO-ANCA) or proteinase 3 (PR3-ANCA), proteins which are expressed primarily in neutrophils. The result generally includes inflammation and destruction of small and medium-sized blood vessels, rapidly progressive glomerulonephritis, and the presence of circulating antibodies against MPO-ANCA and PR3-ANCA. The blood vessels of the kidney or lung are most commonly affected by this disease. ANCAs lead to small vessel vasculitis and crescentic glomerulonephritis. In the United States, 40,000-75,000 new cases are reported each year. Patients are prone to relapse with 11-16% of patients progressing to end-stage renal disease and death within one year of diagnosis. The current treatment regimen consists of high-dose steroids, typically prednisone, in combination with immunosuppressants, such as cyclophosphamide and rituximab. The steroids eventually need to be tapered off due to its side-effect. It is believed that the treatments contribute to ~60% of mortality rate. Without wishing to be bound by theory, it is believed that the antibody molecules described herein can have certain clinical benefits of C5aR1 targeting (e.g., BVAS score, reduced uACR, or reduced urinary MCP-1), which can allow for reduced use or replacement of high dose glucocorticoids in induction therapy for improved safety profile and quality of life.

ANCA-vasculitis progression generally involves two key facets: the initial production and presence of ANCAs and C5a-C5aR1 signaling in neutrophils. The potent anaphylatoxin, C5a, promotes chemotaxis and activation of neutrophils, a key driver in inflammatory diseases driven by type III hypersensitivities such as ANCA-vasculitis. The binding of C5a to C5aR1 is one of the terminal events in the complement pathway that has pleiotropic effects, with one major consequence being the migration, trafficking, and activation of leukocytes, including neutrophils. ANCA-vasculitis symptoms can be induced in mice by passive transfer of anti-MPO serum, indicating that the presence of ANCAs alone can initiate the disease in wild type mice. Additionally, passive transfer of anti-MPO serum to C5aR1-/- mice does not induce ANCA-vasculitis symptoms, indicating that C5aR1 is critical for disease progression in mice. Additionally, administration of C5aR1 antagonists in an MPO-ANCA model can limit the humoral response to MPO.

MPO and PR3 are stored in neutrophil granules and are released upon activation. Resting neutrophils do not have cell surface associated MPO and have low levels of cell surface associated PR3. Neutrophil priming is required for further ANCA-induced activation, which can be accomplished by various cytokines including TNF-alpha, IL-1, IL-6, IL-18, fMLF, and C5a. ANCA-vasculitis disease onset is often preceded by an infection, providing a possible mechanism for cytokine release, neutrophil priming, and subsequent ANCA activation. C5a production and C5aR1 signaling promote further recruitment and activation of neutrophils.

Standards for measuring ANCA-vasculitis include, e.g., Birmingham Vasculitis Activity Score as described, e.g., in Luqmani et al (1994) QJM 87(11):671-678; Luqmani et al. (1997) Baillieres Clin Rheumatol 11(2): 423-446; Mukhtyar et al., (2009) *Ann Rheum Dis.* 68(12): 1827-1832.

Other treatments that can be used in combination with the antibody molecule described herein to treat ANCA include, e.g., a glucocorticoid (e.g., prednisolone), cyclophosphamide, an anti-CD20 antibody (e.g., rituximab), a small molecule selective inhibitor of C5a receptor (e.g., avacopan (CCX168)), plasma exchange (PEX), or a maintenance therapy (e.g., an immunosuppressant, e.g., azathioprine or methotrexate.

Henoch-Schönlein Purpura

In an embodiment, the antibody molecule is used to treat or prevent Henoch-Schönlein purpura.

Henoch-Schönlein purpura (HSP, also known as anaphylactoid purpura, purpura rheumatica, or Schönlein-Henoch purpura) is a disease of the skin and other organs that most commonly affects children. HSP is a systemic vasculitis (inflammation of blood vessels) and is characterized by deposition of immune complexes of IgA and complement component 3 (C3) on arterioles, capillaries, and venules. In the skin, the disease causes palpable purpura (small hemorrhages); often with joint and abdominal pain. With kidney involvement, there may be a loss of small amounts of blood and protein in the urine; in a small proportion of cases, the kidney involvement proceeds to chronic kidney disease even irreversible kidney damage. HSP is often preceded by an infection, such as a throat infection.

Symptoms of Henoch-Schönlein purpura include, e.g., rash (purpura), swollen or sore joints (arthritis), gastrointestinal symptoms (e.g., abdominal pain, nausea, vomiting or bloody stools), and kidney involvement (e.g., protein or blood in the urine). Serum levels of IgA are high in HSP patients.

Standards for defining Henoch-Schönlein purpura include, e.g., the 1990 American College of Rheumatology (ACR) classification (Mills et al. (1990). Arthritis and Rheumatism 33 (8): 1114-21), the 1994 Chapel Hill Consensus Conference (CHCC) (Jennette et al. (1994) Arthritis and Rheumatism 37 (2): 187-92), and the 2006 European League Against Rheumatism (EULAR) and Pediatric Rheumatology Society (PReS) classification, which includes palpable purpura as a mandatory criterion, together with at least one of the following findings: diffuse abdominal pain, predominant IgA deposition (confirmed on skin biopsy), acute arthritis in any joint, and renal involvement (as evidenced by the presence of blood and/or protein in the urine) (Ozen et al. (2006) Annals of Rheumatic Diseases 65 (7): 936-41).

Other treatments that can be used in combination with the antibody molecule described herein to treat Henoch-Schönlein purpura include, e.g., analgesics for the abdominal and joint pains, steroids (e.g., oral steroids or a combination of intravenous methylprednisolone (steroid), cyclophosphamide and dipyridamole followed by prednisone). Other regimens also include, e.g., steroids/azathioprine, and steroids/cyclophosphamide (with or without heparin and warfarin), or intravenous immunoglobulin (IVIG).

Acute Proliferative Glomerulonephritis

In another embodiment, the antibody molecule is used to treat acute proliferative glomerulonephritis, e.g., post-streptococcal glomerulonephritis.

Acute proliferative glomerulonephritis is a disorder of the glomeruli (glomerulonephritis), or small blood vessels in the kidneys. It is a common complication of bacterial infections, typically skin infection by *Streptococcus* bacteria types 12, 4 and 1 (impetigo) but also after streptococcal pharyngitis, for which it is also known as postinfectious or poststreptococcal glomerulonephritis. The infection causes blood vessels in the kidneys to develop inflammation, which hampers the renal organs ability to filter urine.

The pathophysiology of this disorder is consistent with an immune complex mediated mechanism. This disorder produces proteins that have different antigenic determinants, which in turn have an affinity for sites in the glomerulus. As soon as binding occurs to the glomerulus, via interaction with properdin, complement is activated. Complement fixation causes the generation of additional inflammatory mediators.

Symptoms of acute proliferative glomerulonephritis include, e.g., hematuria, oliguria, edema, hypertension, fever, headache, malaise, anorexia, and nausea.

Other treatments that can be used in combination with the antibody molecule described herein to treat cute proliferative glomerulonephritis includes, e.g., blood pressure (BP) control and control of the amount of potassium in individuals with oliguric acute kidney injury.

Autoimmune Disorders

The antibody molecules described herein can be used to treat or prevent an autoimmune disorder.

Exemplary autoimmune disorders that can be treated or prevented by the antibody molecule described herein include, but are not limited to, lupus, acute Disseminated Encephalomyelitis (ADEM), acute necrotizing hemorrhagic leukoencephalitis, Addison's disease, agammaglobulinemia, alopecia areata, amyloidosis, ankylosing spondylitis, anti-GBM/anti-TBM nephritis, antiphospholipid syndrome (APS), autoimmune angioedema, autoimmune aplastic anemia, autoimmune dysautonomia, autoimmune hepatitis, autoimmune hyperlipidemia, autoimmune immunodeficiency, autoimmune inner ear disease (AIED), autoimmune myocarditis, autoimmune oophoritis, autoimmune pancreatitis, autoimmune retinopathy, autoimmune thrombocytopenic purpura (ATP), autoimmune thyroid disease, autoimmune urticaria, axonal & neuronal neuropathies, Balo disease, Behcet's disease, bullous pemphigoid, cardiomyopathy, Castleman disease, celiac disease, Chagas disease, chronic fatigue syndrome, chronic inflammatory demyelinating polyneuropathy (CIDP), chronic recurrent multifocal ostomyelitis (CRMO), Churg-Strauss syndrome, cicatricial pemphigoid/benign mucosal pemphigoid, Crohn's disease, Cogans syndrome, cold agglutinin disease, congenital heart block, coxsackie myocarditis, CREST disease, essential mixed cryoglobulinemia, demyelinating neuropathies, dermatitis herpetiformis, dermatomyositis, Devic's disease (neuromyelitis optica), discoid lupus, Dressler's syndrome, endometriosis, eosinophilic esophagitis, eosinophilic fasciitis, Erythema nodosum, experimental allergic encephalomyelitis, Evans syndrome, fibromyalgia, fibrosing alveolitis, giant cell arteritis (temporal arteritis), giant cell myocarditis, glomerulonephritis, Goodpasture's syndrome, granulomatosis with polyangiitis (GPA) (formerly called Wegener's Granulomatosis), Graves' disease, Guillain-Barre syndrome, Hashimoto's encephalitis, Hashimoto's thyroiditis, hemolytic anemia, Henoch-Schonlein purpura, Herpes gestationis, hypogammaglobulinemia, idiopathic thrombocytopenic purpura (ITP), IgA nephropathy, IgG4-related sclerosing disease, immunoregulatory lipoproteins, inclusion body myositis, interstitial cystitis, juvenile arthritis, juvenile diabetes (type 1 diabetes), juvenile myositis, Kawasaki syndrome, Lambert-Eaton syndrome, Leukocytoclastic vasculitis, Lichen planus, Lichen sclerosus, Ligneous conjunctivitis, linear IgA disease (LAD), pupus (SLE), Lyme disease, chronic, Meniere's disease, microscopic polyangiitis, mixed connective tissue disease (MCTD), Mooren's ulcer, Mucha-Habermann disease, multiple sclerosis, myasthenia gravis, myositis, narcolepsy, neuromyelitis optica (Devic's), neutropenia, ocular cicatricial pemphigoid, optic neuritis, palindromic rheumatism, PANDAS (Pediatric Autoimmune Neuropsychiatric Disorders Associated with *Streptococcus*), paraneoplastic cerebellar degeneration, paroxysmal nocturnal hemoglobinuria (PNH), Parry Romberg syndrome, Parsonnage-Turner syndrome, Pars planitis (peripheral uveitis), pemphigus, peripheral neuropathy, perivenous encephalomyelitis, pernicious anemia, POEMS syndrome, polyarteritis *nodosa*, Type I, II, & III autoimmune polyglandular syndromes, polymyalgia rheumatica, polymyositis, postmyocardial infarction syndrome, postpericardiotomy syndrome, progesterone dermatitis, primary biliary cirrhosis, primary sclerosing cholangitis, psoriasis, psoriatic arthritis, idiopathic pulmonary fibrosis, pyoderma gangrenosum, pure red cell aplasia, raynauds phenomenon, reactive arthritis, reflex sympathetic dystrophy, reiter's syndrome, relapsing polychondritis, restless legs syndrome, retroperitoneal fibrosis, rheumatic fever, rheumatoid arthritis, sarcoidosis, Schmidt syndrome, scleritis, scleroderma, Sjogren's syndrome, sperm & testicular autoimmunity, stiff person syndrome, subacute bacterial endocarditis (SBE), Susac's syndrome, sympathetic ophthalmia, Takayasu's arteritis, temporal arteritis/Giant cell arteritis, thrombocytopenic purpura (TTP), Tolosa-Hunt syndrome, transverse myelitis, Type 1 diabetes, ulcerative colitis, undifferentiated connective tissue disease (UCTD), uveitis, vasculitis, vesiculobullous dermatosis, vitiligo, Wegener's granulomatosis (also known as Granulomatosis with Polyangiitis (GPA).

In an embodiment, the autoimmune disorder is rheumatoid arthritis, systemic lupus erythematosus, a linear IgA bullous disease (e.g., linear immunoglobulin A (IgA) dermatosis), or IgA-mediated epidermolysis bullosa acquisita.

In an embodiment, the antibody molecule is used to treat rheumatoid arthritis. Other treatments that can be used in combination with the antibody molecule described herein to treat rheumatoid arthritis includes, e.g., an NSAID, a steroid (e.g., corticosteroid), a disease-modifying antirheumatic drug (DMARD) (e.g., methotrexate (TREXALL®), leflunomide (ARAVA®), hydroxychloroquine (PLAQUENIL®), or sulfasalazine (AZULFIDINE®), a biologic response modifier (e.g., abatacept (ORENCIA®), adalimumab (HUMIRA®), anakinra (KINERET®), certolizumab (CIMZIA®), etanercept (ENBREL®), golimumab (SIMPONI®), infliximab (REMICADE®), rituximab (RITUXAN®) and tocilizumab (ACTEMRA®), or Tofacitinib (XELJANZ®)), or surgery.

In an embodiment, the antibody molecule is used to treat systemic lupus erythematosus. Other treatments that can be used in combination with the antibody molecule described herein to treat rheumatoid arthritis includes, e.g., an NSAID, an antimalarial drug (e.g., hydroxychloroquine (PLAQUENIL®), corticosteroid (e.g., prednisone), an immunosuppressant (e.g., azathioprine (IMURAN®, AZASAN®), mycophenolate (CELLCEPT®), leflunomide (ARAVA®), or methotrexate (TREXALL®)), or a BAFF inhibitor (e.g., belimumab (BENLYSTA®).

In an embodiment, the antibody molecule is used to treat a linear IgA bullous disease (e.g., linear immunoglobulin A (IgA) dermatosis). Other treatments that can be used in combination with the antibody molecule described herein to treat a linear IgA bullous disease (e.g., linear immunoglobulin A (IgA) dermatosis) include, e.g., corticosteroids (e.g., prednisone or prednisolone), an antibiotic (e.g., tetracycline, erythromycin, sulfapyridine), colchicine, or mycophenolate mofetil.

In an embodiment, the antibody molecule is used to treat IgA-mediated epidermolysis bullosa acquisita. Other treatments that can be used in combination with the antibody molecule described herein to treat IgA-mediated epidermolysis bullosa acquisita includes, e.g., an antibiotic, an anti-inflammatory drug (e.g., corticosteroid), or surgery.

Cancer

The antibody molecules described herein can be used to treat or prevent a cancer or a metastatic lesion thereof.

In an embodiment, the cancer is a solid tumor. In an embodiment, the cancer is a hematological cancer (e.g., a leukemia, a lymphoma, and a multiple myeloma). In an embodiment, the cancer is a soft tissue sarcoma. In an embodiment, the cancer is associated with C5aR1 activation.

Exemplary cancers that can be treated or prevented by the polypeptides described herein include, but are not limited to, acute lymphoblastic leukemia (ALL), acute myeloid leukemia (AML), adrenocortical carcinoma, Kaposi sarcoma, an AIDS-related lymphoma, primary central nervous system (CNS) lymphoma, anal cancer, appendix cancer, astrocytoma, atypical teratoid/rhabdoid tumor, basal cell carcinoma, bile duct cancer, bladder cancer, bone cancer (e.g., Ewing sarcoma or osteosarcoma and malignant fibrous histiocytoma), brain tumor (e.g., astrocytomas, brain stem glioma, central nervous system atypical teratoid/rhabdoid tumor, central nervous system embryonal tumor, central nervous system germ cell tumor, craniopharyngioma, or ependymoma), breast cancer, bronchial tumor, Burkitt lymphoma, carcinoid tumor (e.g., gastrointestinal carcinoid tumor), cardiac (heart) tumor, embryonal tumor, germ cell tumor, lymphoma, cervical cancer, cholangiocarcinoma, chordoma, chronic lymphocytic leukemia (CLL), chronic myelogenous leukemia (CML), chronic myeloproliferative neoplasm, colon cancer, colorectal cancer, craniopharyngioma, cutaneous T-cell lymphoma, ductal carcinoma in situ (DCIS), endometrial cancer, ependymoma, esophageal cancer, esthesioneuroblastoma, Ewing sarcoma, extracranial germ cell tumor, extragonadal germ cell tumor, eye cancer (e.g., intraocular melanoma or retinoblastoma), fallopian tube cancer, fibrous histiocytoma of bone, osteosarcoma, gallbladder cancer, gastric (stomach) cancer, gastrointestinal carcinoid tumor, gastrointestinal stromal tumors (GIST), germ cell tumor (e.g., central nervous system tumor, extracranial tumor, extragonadal tumor, ovarian cancer, or testicular cancer), gestational trophoblastic disease, glioma, hairy cell leukemia, head and neck cancer, hepatocellular (liver) cancer, Hodgkin lymphoma, hypopharyngeal cancer, intraocular melanoma, islet cell tumor, pancreatic neuroendocrine tumor, Kaposi sarcoma, kidney cancer (e.g., renal cell cancer or Wilms tumor), Langerhans cell histiocytosis (LCH), laryngeal cancer, leukemia (e.g., acute lymphoblastic leukemia (ALL), acute myeloid leukemia (AML), chronic lymphocytic leukemia (CLL), chronic myelogenous leukemia (CML), or hairy cell leukemia), lip and oral cavity cancer, liver cancer, lung cancer (e.g., non-small cell lung cancer (NSCLC) or small cell lung cancer), lymphoma (e.g., aids-related, Burkitt lymphoma, cutaneous T-cell lymphoma, Hodgkin lymphoma, non-Hodgkin lymphoma, or primary central nervous system (CNS) lymphoma), Waldenström macroglobulinemia, male breast cancer, malignant fibrous histiocytoma of bone and osteosarcoma, melanoma (e.g., intraocular (eye) melanoma), Merkel cell carcinoma, mesothelioma, metastatic squamous neck cancer, midline tract carcinoma, mouth cancer, multiple endocrine neoplasia syndrome, multiple myeloma/plasma cell neoplasm, mycosis fungoides, myelodysplastic syndrome, myelodysplastic/myeloproliferative neoplasm, chronic myeloproliferative neoplasm, nasal cavity and paranasal sinus cancer, nasopharyngeal cancer, neuroblastoma, oral cancer, lip and oral cavity cancer, oropharyngeal cancer, osteosarcoma and malignant fibrous histiocytoma of bone, ovarian cancer (e.g., epithelial ovarian cancer or germ cell ovarian tumor), pancreatic cancer, pancreatic neuroendocrine tumors (islet cell tumors), papillomatosis, paraganglioma, paranasal sinus and nasal cavity cancer, parathyroid cancer, penile cancer, pharyngeal cancer, pheochromocytoma, pituitary tumor, pleuropulmonary blastoma, peritoneal cancer, prostate cancer, rectal cancer, retinoblastoma, rhabdomyosarcoma, salivary gland cancer, sarcoma (e.g., Ewing sarcoma, Kaposi sarcoma, osteosarcoma, rhabdomyosarcoma, soft tissue sarcoma, or uterine sarcoma), Sézary syndrome, skin cancer (e.g., melanoma, Merkel cell carcinoma, or nonmelanoma skin cancer), small intestine cancer, squamous cell carcinoma, testicular cancer, throat cancer, thymoma and thymic carcinoma, thyroid cancer, transitional cell cancer of the renal pelvis and ureter, urethral cancer, endometrial uterine cancer, vaginal cancer, vulvar cancer, or a metastatic lesion thereof.

Combination Therapies

The antibody molecules can be used in combination with other therapies. For example, the combination therapy can include an antibody molecule co-formulated with, and/or co-administered with, one or more additional therapeutic agents, e.g., one or more additional therapeutic agents described herein. In other embodiments, the antibody molecules are administered in combination with other therapeutic treatment modalities, e.g., other therapeutic treatment modalities described herein. Such combination therapies may advantageously utilize lower dosages of the administered therapeutic agents, thus avoiding possible toxicities or complications associated with the various monotherapies.

Administered "in combination", as used herein, means that two (or more) different treatments are delivered to the subject before, or during the course of the subject's affliction with a disorder. In an embodiment, two or more treatments are delivered prophylactically, e.g., before the subject has the disorder or is diagnosed with the disorder. In another embodiment, the two or more treatments are delivered after the subject has developed or diagnosed with the disorder. In an embodiment, the delivery of one treatment is still occurring when the delivery of the second begins, so that there is overlap. This is sometimes referred to herein as "simultaneous" or "concurrent delivery." In other embodiments, the delivery of one treatment ends before the delivery of the other treatment begins. In an embodiment of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In an embodiment, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

In certain embodiments, the additional agent is a second antibody molecule, e.g., an antibody molecule different from a first antibody molecule. Exemplary antibody molecules that can be used in combination include, but are not limited to, an antibody molecule as described herein, e.g., in Table 1C.

In an embodiment, the antibody molecule is administered in combination with a second therapy to treat or prevent ANCA-vasculitis.

In an embodiment, the antibody molecule is administered in combination with a small molecule C5aR1 antagonist, such as avacopan or NDT9513727. In an embodiment, the antibody molecule is administered in combination with a high-dose steroid, e.g., prednisone. In an embodiment, the antibody molecule is administered in combination with an immunosuppressant, e.g., cyclophosphamide or rituximab.

In an embodiment, the antibody molecule is administered in combination with an agent described in Table 7, e.g., to treat a disorder described in Table 7.

In an embodiment, the antibody molecule is administered in combination with prednisone and/or cyclophosphamide In an embodiment, prednisone is administered at a dose between 0.2 mg/kg and 2 mg/kg, e.g., between 0.5 mg/kg and 1 mg/kg, e.g., once a day. In an embodiment, cyclophosphamide is administered at a dose between 0.2 g and 2 g, e.g., between 0.5 g and 1 g, e.g., once a day.

In an embodiment, the antibody molecule is administered in combination with rituximab (RITUXAN®). Rituximab is a chimeric anti-CD20 monoclonal antibody. In an embodiment, rituximab is administered at a dose between 100 mg/m$^2$ and 500 mg/m$^2$, e.g., between 200 mg/m$^2$ and 450 mg/m$^2$ or between 300 mg/m$^2$ and 400 mg/m$^2$, intravenously, e.g., once weekly, once every two weeks, once every four weeks, or once every eight weeks.

Exemplary therapies that can be used in combination with an antibody molecule or composition described herein to treat or prevent other disorders are also described in the section of "Methods of Treating or Preventing Disorders" herein.

Methods of Diagnosis

In some aspects, the present disclosure provides a diagnostic method for detecting the presence of C5aR1 in vitro (e.g., in a biological sample, such as a biopsy or blood sample) or in vivo (e.g., in vivo imaging in a subject). The method includes: (i) contacting the sample with an antibody molecule described herein, or administering to the subject, the antibody molecule; (optionally) (ii) contacting a reference sample, e.g., a control sample (e.g., a control biological sample, such as a biopsy or blood sample) or a control subject with an antibody molecule described herein; and (iii) detecting formation of a complex between the antibody molecule and C5aR1 in the sample or subject, or the control sample or subject, wherein a change, e.g., a statistically significant change, in the formation of the complex in the sample or subject relative to the control sample or subject is indicative of the presence of C5aR1 in the sample. The antibody molecule can be directly or indirectly labeled with a detectable substance to facilitate detection of the bound or unbound antibody. Suitable detectable substances include various enzymes, prosthetic groups, fluorescent materials, luminescent materials and radioactive materials, as described above and described in more detail below.

The term "sample," as it refers to samples used for detecting a polypeptide (e.g., C5aR1) or a nucleic acid encoding the polypeptide includes, but is not limited to, cells, cell lysates, proteins or membrane extracts of cells, body fluids such as blood, or tissue samples such as biopsies.

Complex formation between the antibody molecule, and C5aR1, can be detected by measuring or visualizing either the antibody molecule bound to C5aR1 or unbound antibody molecule. Any suitable detection assays can be used, and conventional detection assays include an enzyme-linked immunosorbent assays (ELISA), a radioimmunoassay (RIA) or tissue immunohistochemistry. Alternative to labeling the antibody molecule, the presence of C5aR1 can be assayed in a sample by a competition immunoassay utilizing standards labeled with a detectable substance and an unlabeled antibody molecule. In this assay, the biological sample, the labeled standards and the antibody molecule are combined and the amount of labeled standard bound to the unlabeled binding molecule is determined. The amount of C5aR1 in the sample is inversely proportional to the amount of labeled standard bound to the antibody molecule.

The antibody molecules described herein can be used to diagnose disorders that can be treated or prevented by the antibody molecules described herein. The detection or diagnostic methods described herein can be used in combination with other methods described herein to treat or prevent a disorder described herein.

EXAMPLES

Example 1: Development of Anti-C5aR1 Antibody Molecules

This Example describes the development of anti-C5aR1 antagonistic antibody.

Antagonistic antibodies that inhibit (e.g., prevent) the binding and/or signaling of the soluble agonist C5a to C5aR1 were generated. Briefly, mice were immunized with relevant antigens, followed by creation of hybridomas and interrogation of the hybridoma repertoire for C5aR1-specific antibodies that showed antagonistic activity against C5a-mediated C5aR1 signaling, e.g., resulting in inhibited calcium mobilization and chemotaxis of neutrophils in the presence of C5a.

Immunization

Mice were immunized with different immunogens, including C5aR1 DNA, C5aR1 virus-like particles (VLPs) and/or C5aR1 peptides representing N-terminal region and extracellular loop 2 (ECL2) of human C5aR1 Immunizations were performed in both wild type CD1 mice and in C5aR1 knock-out mice. DNA immunization was performed by hydrodynamic tail vein injection or intradermal injection followed by electroporation. VLP immunization was performed by subcutaneous injection with the use of adjuvant at an adjacent injection site. A final boost was performed with VLPs and/or C5aR1 peptides by tail vein injection 72 and 48 hours prior to splenic harvest.

Subsequent splenic fusion followed by hybridoma screening successfully identified functional antibodies that blocked C5aR1 signaling Hybridoma cell lines were created by polyethene glycol fusion of spleen cells with a myeloma fusion partner. Cells were plated into 384 well plates and grown for 2-3 weeks. Upon outgrowth, the supernatant was screened for reactivity to C5aR1 and C5aR2 in a VLP ELISA. Clones with specificity for C5aR1 were expanded for cryopreservation and RNA extraction. RT-PCR was performed to amplify antibody heavy and light chain transcripts followed by Sanger sequencing. Upon sequence identification, recombinant antibodies were expressed, purified, and tested for their ability to prevent C5aR1 signaling in a panel of orthogonal assays.

The following approaches were utilized to increase the number and diversity of anti-C5aR1 antibodies:

1. DNA immunization in combination with heterologous C5aR1-VLP protein boosts were used to increase the human C5aR1 immune response. DNA immunization typically elicits a weaker immune response compared to protein immunization, so it was expected that C5aR1-VLPs should augment the response.
2. Next generation sequencing (NGS) of mouse splenocytes were used to identify clonal siblings of antibodies uncovered by NGS. Clonal variants were recombinantly expressed and their ability to block C5aR1 signaling were compared to the parental molecule.
3. C5aR1 knock-out mice were also immunized to reduce the tolerance imposed by the homologous mouse C5aR1. Despite sequence differences, human C5a can bind to both human and mouse C5aR1, indicating that structural homology is strong between the two species.
4. The use of genetic adjuvants, including DNA encoding IL-12a and CD40L, were used during DNA immunization to augment the humoral response to C5aR1.
5. All hybridoma plating and screening were performed in 384 well plates to increase the throughput.

Antibodies against Site I and antibodies against Site II were both identified and selected for their ability to inhibit C5a binding to C5aR1.

In Vitro Hybridoma Screening Strategy

Hybridoma supernatant was screened for reactivity to C5aR1 using a high-throughput 384-well VLP-based ELISA. Briefly, C5aR1 or C5aR2 VLPs were immobilized to a MaxiSorp ELISA plate at a concentration of 30 µg/mL and incubated overnight at 4° C. The following morning, plates were washed 3 times with 1×PBS and plates were blocked for 30 minutes with 100 µL of PBSA (1×PBS with 3% BSA). A serial titration of anti-C5aR1 antibody was performed in the presence of PBSA and incubated for 1 hour at room temperature. Plates were washed 6 times with PBSA. Anti-human-HRP was diluted in PBSA, added to all wells, and incubated for 45 minutes at room temperature. Plates were washed 6 times with PBS. TMB substrate was added to all wells and incubated for 10 minutes before the addition of stop solution (0.1 M sulfuric acid). Absorbance at 450 nm was measured on a standard plate reader. A four-parameter curve fit was used to generate the EC50 value of the antibody titration in nM. The results of the VLP ELISA are shown in Table 5 below.

TABLE 5

Reactivity of antibodies to C5aR1 and C5aR2 by VLP ELISA ($EC_{50}$ values reported in nM of antibody)
C5aR1 and C5aR2 ELISA, EC50 value reported in nM of antibody

| Antibody | C5aR1 | C5aR2 | Antibody | C5aR1 | C5aR2 | Antibody | C5aR1 | C5aR2 |
|---|---|---|---|---|---|---|---|---|
| Anti-C5aR1 | >3.16E-8 | <1E-12 | Clone_338_V1-2 | 8.5E-09 | >3.16E-8 | Clone_511 | 2.01E-09 | >3.16E-8 |
| Clone_11 | 1.20E-11 | >3.16E-8 | Clone_341_V1 | 1.64E-11 | >3.16E-8 | Clone_511_V2 | 1.46E-09 | >3.16E-8 |
| Clone_11_V2 | 7.00E-12 | >3.16E-8 | Clone_341_V1-2 | 2.65E-08 | >3.16E-8 | Clone_518 | 1.2E-09 | >3.16E-8 |
| Clone_66 | 6.07E-12 | >3.16E-8 | Clone_341_V2-1 | 9.57E-09 | >3.16E-8 | Clone_518_V2 | 1.39E-09 | >3.16E-8 |
| Clone_79 | 1.42E-11 | >3.16E-8 | Clone_341_V2-2 | 1.51E-08 | >3.16E-8 | Clone_528 | 7.34E-10 | >3.16E-8 |
| Clone_184 | 1.11E-11 | >3.16E-8 | Clone_399 | 5.72E-12 | >3.16E-8 | Clone_541 | 7.93E-10 | >3.16E-8 |
| Clone_216 | 7.12E-11 | >3.16E-8 | Clone_402 | <1E-12 | >3.16E-8 | Clone_547 | 8.08E-10 | >3.16E-8 |
| Clone_272 | 1.12E-10 | >3.16E-8 | Clone_429 | 6.33E-09 | >3.16E-8 | Clone_549 | 1.11E-10 | >3.16E-8 |
| Clone_317_V1-2 | 1.28E-10 | >3.16E-8 | Clone_430 | 8.14E-10 | >3.16E-8 | Clone_550 | 3.45E-10 | >3.16E-8 |
| Clone_317_V2 | 5.39E-10 | 1.51E-09 | Clone_440 | 6.5E-12 | >3.16E-8 | Clone_553 | 7.61E-11 | >3.16E-8 |
| Clone_317_V2-1 | 7.66E-12 | >3.16E-8 | Clone_453 | 7.65E-12 | >3.16E-8 | Clone_556 | 5.03E-11 | >3.16E-8 |
| Clone_322 | 1.4E-12 | >3.16E-8 | Clone_454 | >3.16E-8 | >3.16E-8 | Clone_567 | 2.06E-11 | >3.16E-8 |
| Clone_322_V2 | 1.05E-12 | >3.16E-8 | Clone_465 | 6.7E-11 | >3.16E-8 | Clone_568 | 1.11E-12 | >3.16E-8 |
| Clone_330 | 2.42E-10 | >3.16E-8 | Clone_475 | 1.65E-10 | >3.16E-8 | Clone_570 | 1.71E-10 | >3.16E-8 |
| Clone_336_V1 | 1.87E-09 | 9.38E-09 | Clone_481 | 8.45E-12 | >3.16E-8 | Clone_573 | 1.64E-11 | >3.16E-8 |
| Clone_336_V1-2 | 3.05E-10 | 4.29E-10 | Clone_497 | 5.82E-10 | >3.16E-8 | Clone_583 | <1E-12 | >3.16E-8 |
| Clone_336_V2 | 2.14E-08 | >3.16E-8 | Clone_503 | 3.82E-11 | >3.16E-8 | Clone_584 | 2.82E-12 | 2.71E-10 |
| Clone_336_V2-1 | 1.92E-10 | 1.71E-08 | Clone_503_V2 | 1.91E-08 | >3.16E-8 | Clone_585 | 7.31E-12 | >3.16E-8 |
| Clone_336_V3-1 | 6.63E-11 | >3.16E-8 | Clone_507 | 3.81E-10 | >3.16E-8 | Clone_586 | <1E-12 | >3.16E-8 |
| Clone_336_V3-2 | 1.27E-11 | 3E-08 | Clone_508 | >3.16E-8 | >3.16E-8 | Clone_588 | 1.61E-11 | >3.16E-8 |
| Clone_338_V1 | 1.28E-09 | >3.16E-8 | Clone_510 | 1.23E-09 | >3.16E-8 | Clone_592 | <1E-12 | >3.16E-8 | discovered by hybridoma screening. Due to the limited depth of hybridoma screening, it was expected that clonal variants, some of which may have improved functionality or biophysical properties, would be Follow up screening to ensure specificity was performed by measuring cell surface binding to cells expressing, for example, human C5aR1, human C5aR2, mouse C5aR1, and control cells that were mock transfected. Briefly, cell surface binding was performed on various C5aR1 expressing cell lines (transiently expressed Expi293 cells, stable C5aR1-U937 cells, and neutrophils isolated from whole blood). Briefly, a titration of antibody diluted in flow buffer (1×PBS with 2% fetal bovine serum) was incubated with cells for 1 hour at 4° C. Cells were washed twice with flow buffer. Anti-human-APC secondary antibody was diluted 1:400 in flow buffer and incubated with cells for 30 minutes. Cells were washed twice with flow buffer and resuspended in 100 μL of flow buffer. Fluorescence was measured using the iQue Screen Plus flow cytometer. The results of the cell binding assay are shown in Table 6 below.

TABLE 6

Binding of exemplary anti-C5aR1 antibodies to human C5aR1 transiently expressed on the surface of Expi293 cells. Values represent the geometric mean fluorescent intensity for staining with 100 nM of antibody.
Cell Surface binding to human C5aR1 transiently expressed on the surface of Expi293 Cells

| Antibody | Human C5aR1 | Mock transfection | Antibody | Human C5aR1 | Mock transfection | Antibody | Human C5aR1 | Mock transfection |
|---|---|---|---|---|---|---|---|---|
| Clone_11v2 | 310,187 | 4,976 | Clone_454 | 416,030 | 6,232 | Clone_556 | 550,678 | 7,127 |
| Clone_66 | 280,444 | 5,471 | Clone_465 | 202,626 | 4,683 | Clone_567 | 516,557 | 7,270 |
| Clone_79 | 663,741 | 6,820 | Clone_475 | 597,201 | 7,673 | Clone_568 | 604,145 | 6,676 |
| Clone_184 | 456,014 | 8,512 | Clone_503 | 586,998 | 7,927 | Clone_570 | 497,164 | 7,289 |
| Clone_317v2-1 | 8,106 | 4,535 | Clone_507 | 224,419 | 5,273 | Clone_573 | 398,667 | 7,208 |
| Clone_322_v2 | 420,835 | 7,347 | Clone_510 | 176,751 | 5,389 | Clone_583 | 259,523 | 5,291 |
| Clone_336_v2-1 | 223,156 | 5,007 | Clone_511v2 | 222,224 | 5,790 | Clone_584 | 317,914 | 6,223 |
| Clone_329 | 327,683 | 4,776 | Clone_518v2 | 202,739 | 5,576 | Clone_585 | 58,312 | 5,837 |
| Clone_330 | 265,443 | 4,938 | Clone_528 | 235,709 | 5,011 | Clone_586 | 560,702 | 8,826 |
| Clone_402 | 315,064 | 5,974 | Clone_541 | 207,547 | 4,862 | Clone_588 | 621,217 | 6,392 |
| Clone_429 | 191,235 | 5,217 | Clone_547 | 586,606 | 6,575 | Clone_592 | 564,574 | 9,800 |
| Clone_430 | 247,781 | 5,015 | Clone_549 | 241,071 | 4,741 | 2nd only | 5,346 | 3,052 |
| Clone_440 | 289,803 | 5,301 | Clone_550 | 609,348 | 7,458 | Isotype control | 6,553 | 3,722 |
| Clone_453 | 258,623 | 5,398 | Clone_553 | 590,125 | 6,871 | | | |

Reactive clones were purified by protein A/G chromatography. Antibodies that showed specific binding to human C5aR1 were recombinantly expressed and the purified antibodies tested for functionality in different functional assays.

In Vitro Functional Analysis

One of the primary mechanisms by which neutrophils migrate to the site of inflammation is by chemotaxis induced by a C5a/C5adesArg gradient is detected by C5aR1 signaling Anti-C5aR1 antibodies were thus assessed in a chemotaxis assay for their ability to block C5a induced migration of neutrophils. The assay involved cell migration in a double chamber well separated by filters. The cells and inhibitors were applied into the upper chamber and the lower chamber was filled with the chemoattractant, causing the cells to migrate to the lower chamber. The inhibition activity was evaluated by counting the migrated cell numbers. Specifically, a titration of C5a was added to the bottom chamber a 96 transwell plate. Cells expressing human C5aR1 (C5aR1-U937 cells or human neutrophils) were incubated with or without antagonist and then seeded into the top chamber of the transwell plate. The cells were incubated for 2 hours. Cells that migrated to the bottom chamber were quantified using the CyQUANT cell proliferation kit following the manufacturer's protocol. The assay was performed using engineered cells stably expressing C5aR1 as well as using human neutrophils.

Intracellular calcium is released into the cytoplasm by stimulation of GPCRs and acts as a second messenger of GPCR signaling, commonly used to quantify GPCR agonism and antagonism. As such, calcium flux assays using calcium sensitive dye were utilized to detect cytosolic changes in calcium concentration. Cells were incubated with esterified (inactive) calcium dye. The dye penetrated the cell membrane and became active once inside the cell. The active form of the dye became fluorescent after binding to intracellular calcium and the fluorescence was used to determine C5aR1 signaling in response to C5a addition. Specifically, stable C5aR1-U937 cells or neutrophils isolated from whole blood were stained with Fluo-4 Direct Calcium Assay kit from Thermo Fisher for 1 hour at 37° C. Next, antibody or antagonist was incubated with the cells for 30 minutes. The basal fluorescence with an excitation at 494 nm and emission at 516 nm was measured for 15 seconds. C5a was added to the cells and the fluorescence was measured over a span of four minutes. The basal read from before C5a stimulation and the max signal after C5a stimulation were used to calculate the response ratio. The potency of the antibodies was assessed for their ability to inhibit intracellular calcium release in C5aR1 expressing cells in the presence of C5a Similar to the chemotaxis assay, the calcium flux assays were performed using engineered cells stably expressing C5aR1 as well as using human neutrophils.

In addition, a GeneBLAzer reporter assay was used, which mimics the calcium flux assay. The GeneBLAzer assay kit and C5aR1 cell line were commercially available from Thermo Fisher (Catalog #K1544). The assay was performed as recommend by the manufacturer. Briefly, antibodies or antagonists were incubated for 30 minutes at 37° C. C5a was then added to the cells and incubated at 37° C. for an additional 4-5 hours. Beta-lactamase substrate was then added and incubated for 2 hours at room temperature. Fluorescent measurements for each well with an excitation/emission of 409/460 (blue) and 409/530 (green) were measured. An increase in the blue to green ratio was proportional to C5aR1 activation and was used to calculate the percent of activation for the cells in each well.

Figure 3A:
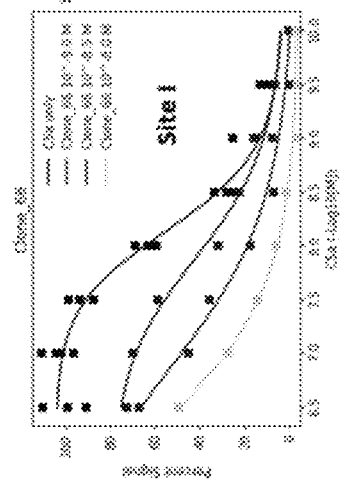
FIGS. 3A-3C are a series of graphs showing that exemplary Site I and Site II antibodies (clones 66 and 79, respectively) in combination (FIG. 3C) were more effective than either antibody alone (clone 66 (FIG. 3A), and clone 79 (FIG. 3B)) in the GeneBLAzer assay.
Figure 3B:
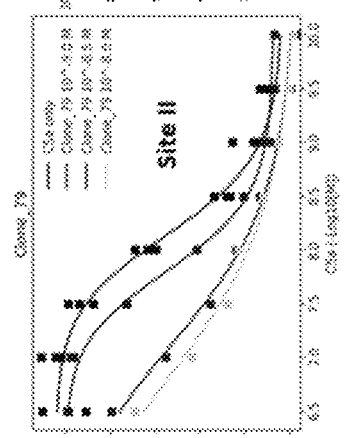
Figure 3C:
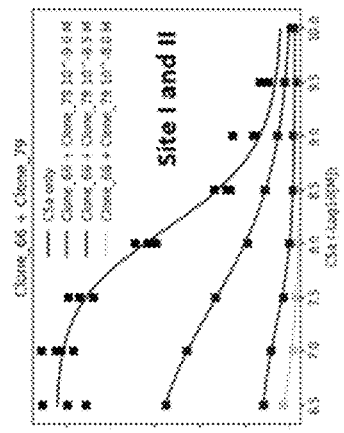

Of the antibodies generated and screened, several were assessed using the GeneBLAzer assay. Antibody clones 66 and 583, which target Site I, were observed to be highly potent and have similar activity in the GeneBLAzer assay compared to Site II antibody clones 11v2 and 329 (FIGS. 2A-2D). In addition, a combination of antibody 66 (which targets Site I) and antibody 79 (which targeted site II) outperformed the activity of each antibody on its own in the GeneBLAzer assay (FIGS. 3A-3C, show that the combination of Site I and Site II targeting antibodies can have an additive or synergistic effect on C5aR1 antagonism.

In Vivo Screening Strategy

The antibodies that most potently inhibit C5aR1 mediated signaling in in vitro assays, will be evaluated in pre-clinical animal models. The antibodies will be evaluated in pharmacodynamic models as well as in an anti-MPO induced necrotizing and crescentic glomerulonephritis (NCGN) disease model.

Administration of C5a intravenously causes a rapid reduction in blood neutrophil counts, which is observable within one minute after administration of C5a. Antagonism of C5aR1 can prevent the rapid reduction of blood neutrophil levels. Administration of anti-C5aR1 antibodies prior C5a challenge is expected to reduce neutropenia in these animals Given the limited identity between human and rodent C5aR1, it is challenging to use wild type mice for evaluation of therapeutics targeting human C5aR1. Indeed, none of the antibodies reported in the literature or small molecules in clinical development cross-react with mouse C5aR1. To test our lead antibodies in rodents, we plan to employ two distinct strategies. The first is through the use of humanized mice with multi-lineage human immune cells. NGS or NSG-SGM3 mice are injected with human CD34+ stem cells and engraftment is confirmed within 12-16 weeks. The engraftment is stable for 12 months before the mice succumb to graft-versus-host disease. NGS-SGM3 mice express human IL3, GM-CSF, and SCF that help to support stable engraftment of myeloid lineages and regulatory T-cells. The second strategy is performing experiments in transgenic mice which has human C5aR1 transgene in place of native mouse C5aR1. Toward this Visterra is working with Jackson Laboratories to create human C5aR1 knock-in mice. Non-human primates present another model to study the pharmacodynamics of the lead antibodies.

ANCA-vasculitis like disease can be induced in mice by passive transfer of anti-MPO IgG. Administration of anti-MPO IgG in mice leads them to develop urinary abnormalities (hematuria, albuminuria and leukocyturia), crescentic glomerulonephritis, and vasculitis. The severity of the disease severity can be enhanced by injection of lipopolysaccharide. Xiao et al. (2014, J Am Soc Nephrol 25(2): p. 225-31) have previously demonstrated that oral administration of avacopan reduced the severity of anti-MPO NCGN in human C5aR1 transgenic mice. The antibodies identified herein will be evaluated in a similar model.

Example 2: Epitope Mapping

This Example describes the mapping of epitopes of each antibody isolated from immunization.

The epitope mapping was undertaken, using biolayer interferometry, on a series of exemplary anti-C5aR1 antibodies generated as described in Example 1. Briefly, for each antibody, biotinylated peptides representing ECL2, the N-terminus with tyrosine sulfation, and the N-terminus without tyrosine sulfation, were immobilized in a streptavidin biosensor. Subsequently, the biosensor was exposed to 10 μg/mL of antibody to detect antibody binding to the immobilized peptide. The results of the epitope mapping study are shown in Table 4 ("+" indicates binding to the listed peptide; "−" indicates lack of binding to the listed peptide).

TABLE 4

Epitopes on C5aR1 for exemplary anti-C5aR1 antibody molecules

| Antibody | Cyclic ECL2 | Sulfated N-terminal | Non-sulfated N-terminal |
|---|---|---|---|
| 66 | − | + | − |
| 79 | + | − | − |
| 184 | − | + | + |
| 317 | + | − | − |
| 322_v2 | − | + | − |
| 329 | + | − | − |
| 332 | − | + | − |
| 335 | − | + | − |
| 336v2-1 | + | − | − |
| 343 | + | − | − |
| 402 | − | + | + |
| 429 | + | − | − |
| 453 | + | − | − |
| 511 | + | − | − |
| 518 | + | − | − |
| 583 | − | + | + |
| 584 | + | − | − |
| 588 | + | − | − |
| 11v2 | + | − | − |

Figure 4C:
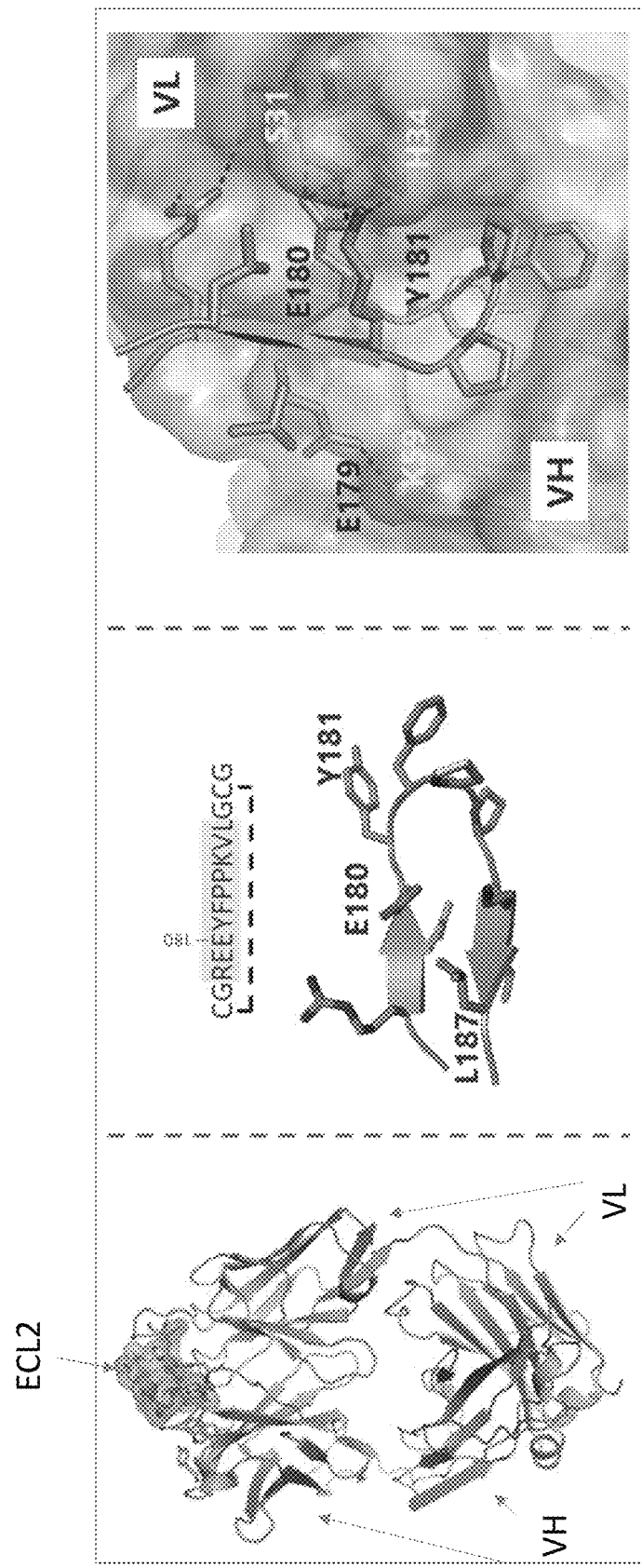
FIG. 4C is an exemplary cartoon diagram of crystal structure of 329-Fab-peptide complex (left panel). The VH and VL are shown in ribbon representations, and ECL2 cyclic peptide is shown in spheres. The central panel shows the primary structure of the cyclic peptide where the highlighted residues (REEYFPPKVL) were derived from ECL2 of human C5aR1 and its 3D structure found in Fab-peptide complex. The peptide is found in a hairpin loop confirmation similar to that of found in the C5aR1 receptor molecule. The right panel shows the binding and molecular interactions of the cyclic peptide with Fab domain. The hydrogen bonds are shown in dotted line and the relevant residues are labeled. The Fab-peptide interactions are mostly with the VL domain CDR resides and E180 residue seems to make most interactions with the antibody.
Figures 5C, 5D, 5E:
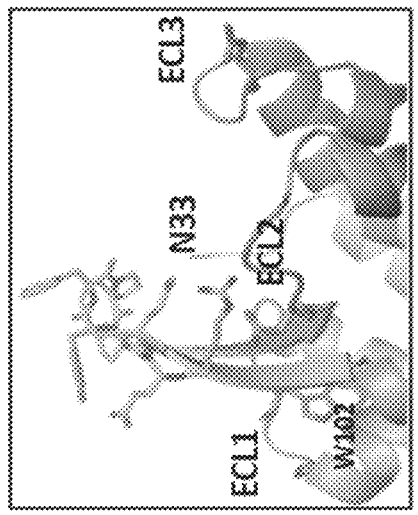
FIG. 5C shows the results of Ala scanning mutations in ECL1.
FIG. 5D shows the results of Ala scanning mutations in ECL3.
FIG. 5E shows structural position of ECL1 and ECL3, with respect to ECL2.
Figure 5F:
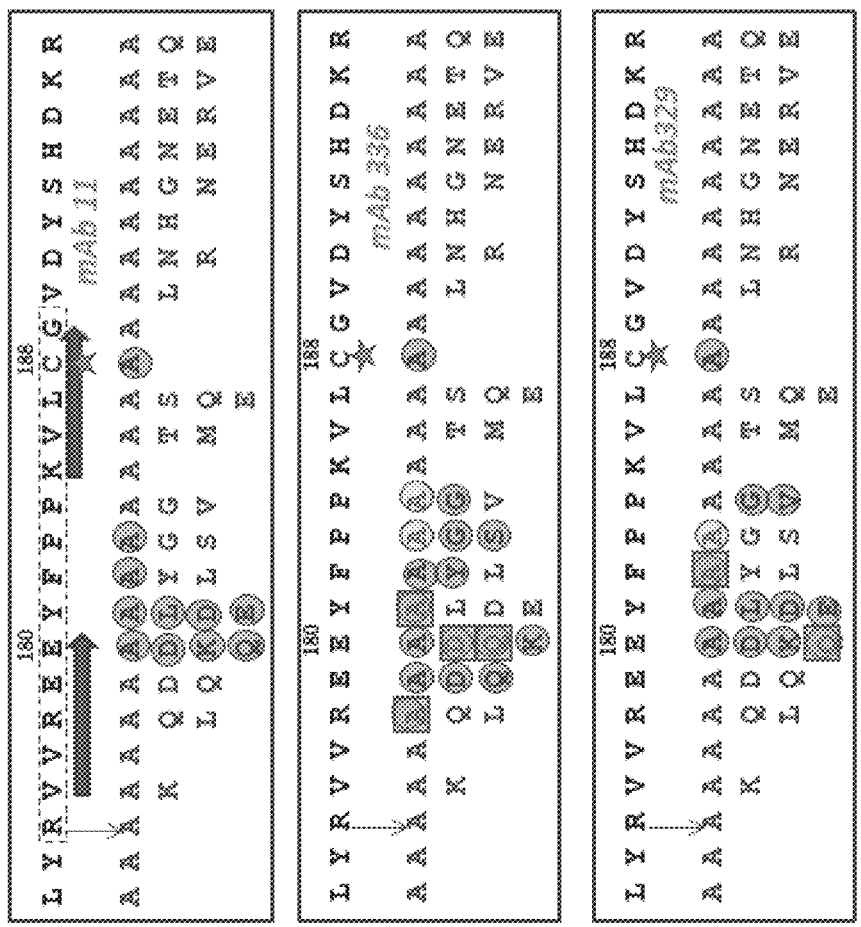
FIG. 5F shows the ala scanning mutations of C5aR1 ECL2 for clones 11, 336, and 329. Mutations that abolished binding are circled.
Figure 6:
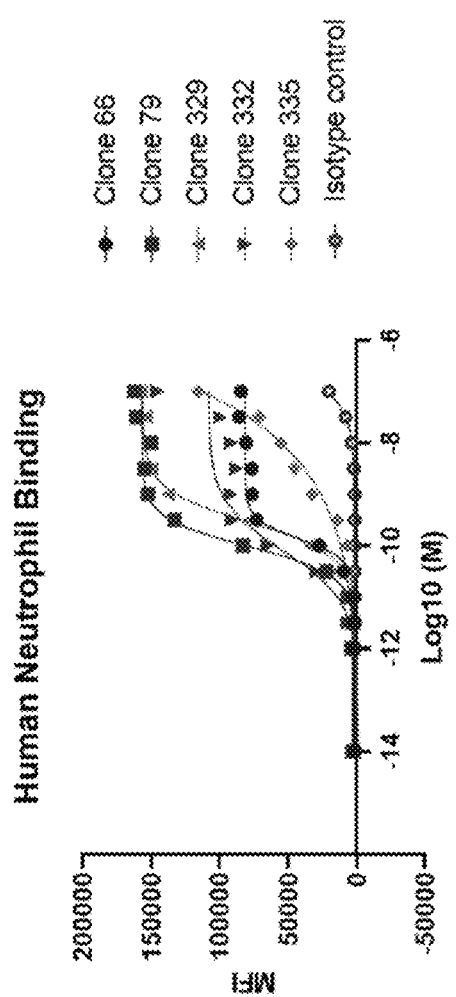
FIG. 6 is a graph showing binding of exemplary anti-C5aR1 antibodies to human neutrophils.

A superposition of bound ECL2 peptide-mAb329 co-crystal with C5aR1 yielded a model of 329 Fab-C5aR1 complex (FIG. 4A), which revealed that of the 15 residues, inner ten are C5aR1 ECL2 residues and nine are making contacts with the Fab domain. As shown in FIG. 4B, the central 5 residues made most interactions with Fab E180 & Y181 are core epitopes whose Ala mutation abolished mAb binding while mutation of Y182, P183 & P184 reduced binding. E180 makes most ES and HB interactions with the LCDR1 residues. E179 made a salt bridge with HCDR2: K59, however epitope mapping showed that E179A mutation did not reduce antibody affinity.

The model of the mab 329 with the ECL2 peptide revealed that residues R35, H101, D191, S193, H194, E266, P267, S268, F272, L273, K276 are the most essential epitopes for antibody binding. Further observation of the antibody-peptide model are noted in Table 8. Fab-C5aR1 model the antibody-receptor interface increases by 80% (580 to 1045 A2).

Based on the crystal structure, the underlined residues on epitope (as shown below) are the residues that are involved in critical contacts for antibody 329 and 583, respectively.

mAb329

Paratopes Residues:
  a) VH: W33, H35, W47, Y50, K58, G97, D98, P100c, Y100d
  b) VL: R24, S25, S26, Q27, S28, V30, H30a, S30b, N30c, G30d, Y32, G66, S67, G68, T69, D70, S91, T92, L93, V94, L96

Epitope Residues on C5aR1:
  c) R35, H101, V176, V177, R178, E179, E180, Y181, F182, P183 P184, K185, L187, D191, S193, H194, E266, P267, S268, F272, L273, K276 mAb583

Paratopes Residues:
  d) VH: A31, Y32, A33, S50, I51, S52, T53, G54, G55, N56, T57, Y58, Q97, R98, F99, S100
  e) VL: H27d, S28e, N28, G29, N30, T31, Y32, K50, V51, S52, N53, S91, T92, H93, 94, V95, P96, Y97

Epitope Residues on C5aR1:
T7, T8, P9, D10Y11, G12, H13, Y14, D15, D16, K17, D18 mutagenesis data did not reveal any contacts with ECL1 or ECL3. The mutation W102A on ECL1 did abolish binding to all site II antibodies; however, this residue contributes to

TABLE 8

The structural description of the interface between ECL2 and mAb 329

|  | VH | VL | Total | C5aR1 binding (Model) VH | VL |
|---|---|---|---|---|---|
| Interface (Å$^2$) | 214 | 366 | 580 | 271 | 774 |
| Hydrogen bonds | 2 | 9 | 11 | 2 | 11 |
| Salt bridges | 1 |  | 2 | 1 | 1 |
| paratopes | W33, H35, W47, Y50, K59, G101, D102, P107, Y108 | Q27, S28, V30, H30a, S30b, N30c, Y37, S96, T97, L98, V99, L101 |  | W33, H35, W47, Y50, K58, G100a, D102, P107, Y108 | R24, S25, S26, Q27, S28, V30, H30a, S30b, N30c, G30d, Y32, G66, S67, G68, T69, D70, S91, T92, L93, V94, L97 (Chothia) |
| Epitopes | CGR<u>EE</u><u>Y</u>FPPKVLGCG | CGREEYFPPKVLGCG |  | E179, Y18, F182, P183, P184 | R35, H101, V176, V177, R178, E179, E180, Y181, F182, P184, K185, L187, D191, S193, H194, E266, P267, S268, F272, L273, K276 |

Site 1 and Site II mAb 583, 11, 336, 329 and 66 Epitope Map

Figure 7:
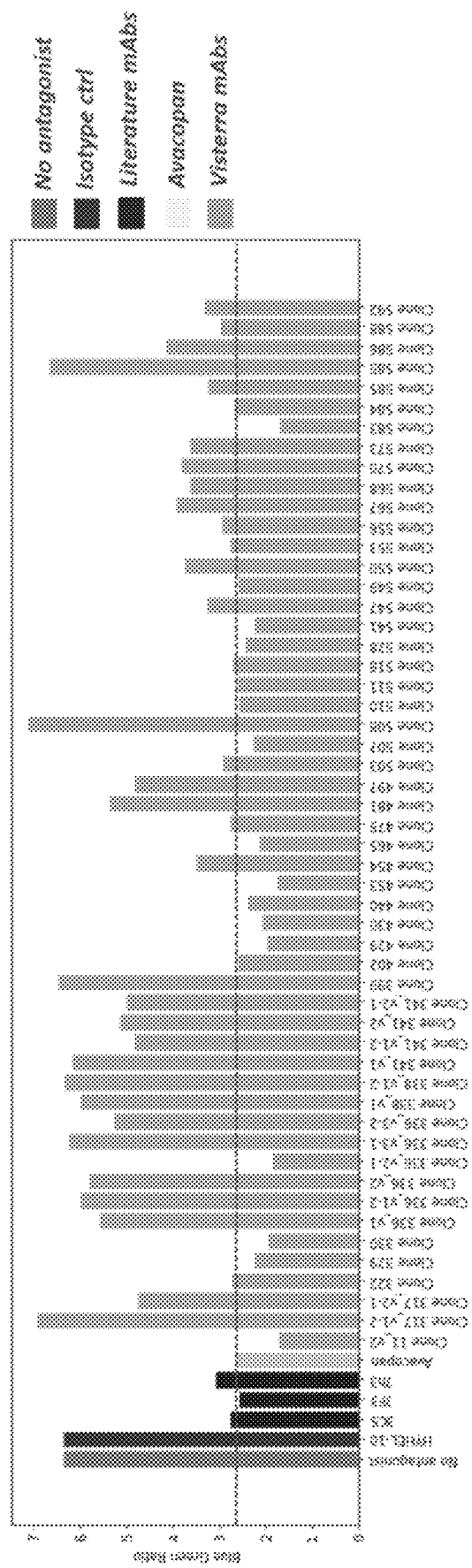
FIG. 7 is a graph showing antagonism of C5aR1 in the GeneBLAzer assay by exemplary anti-C5aR1 antibodies, compared to an isotype control (HYHEL-10), a no-antagonist control, several reference anti-C5aR1 antibodies (i.e., antibodies 3C5, 7F3, and 7h3), and the small molecule inhibitor avacopan.
Figures 10A, 10B, 10C, 10D, 10E, 10F, 10G, 10H, 10I:
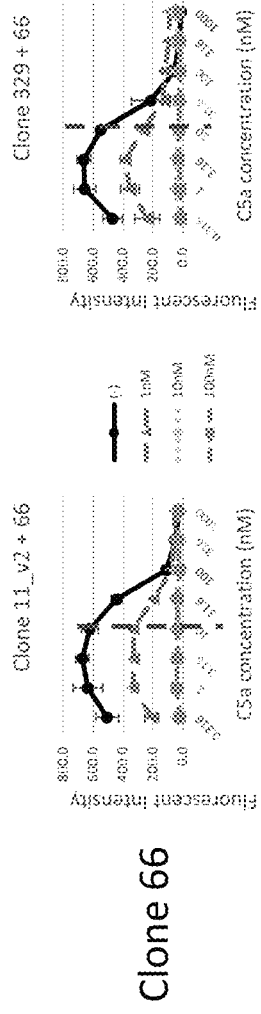
FIGS. 10A-10I are a series of graphs showing C5aR1 inhibition of chemotaxis with different combination of clones of anti-C5aR1 antibodies—Clone 11+Clone 66 (FIG. 10A), Clone 66+Clone 329 (FIG. 10B), Clone 66+Clone 336v2 (FIG. 10C), Clone 11+Clone 583 (FIG. 10D), Clone 583+Clone 329 (FIG. 10E), Clone 583+Clone 336v2 (FIG. 10F), Clone 11+Clone 322 (FIG. 10G), Clone 322+Clone 329 (FIG. 10H), Clone 322+Clone 336v2 (FIG. 10I).

Ala substitutions of T8 & D10 moderately reduces its affinity while Y11 & D15 abolishes mAb binding. A Phe substitution is tolerated at Y11 but acidic and acidic AA at G12 abolished binding. N-glycosylation of at N17 or D17P also abolishes mAb binding. N5 glycan is tolerated but a tandem glycosylation (N5 & N17) is not tolerated. mAb core ep Example 1. Briefly, cells were pre-incubated with 10 nM of antibody followed by addition of 10 nM C5a. The engineered induction of beta-lactamase expression by C5a-C5aR1 signaling was measured using the BLA substrate and calculating the ratio of blue and green fluorescence. As shown in FIG. 7, a number of the anti-C5aR1 antibodies generated herein showed comparable (e.g., clones 322, 402, 365, 603, 210, 511, 518, 549, 553, 556, and 584) or improved (e.g., clones 11v2, 329, 330, 336, 429, 430, 453, 465, 507, 541, and 583) antagonism of C5aR1 compared to reference antibodies or to Avacopan.

Example 5: Inhibition of Chemotaxis by Anti-C5aR1 Antibodies

This Example describes the inhibition of C5a induced chemotaxis by C5aR1 antagonistic antibodies.

In this example, the functional activity of the exemplary anti-C5aR1 antibodies was assessed by measuring their impact on cell chemotaxis, which is known to be induced by C5aR1 activity.

Anti-C5aR1 antibodies were assessed in a chemotaxis assay for their ability to block C5a induced migration of neutrophils. The assay involved cell migration in a double chamber well separated by filters. The cells and inhibitors were applied into the upper chamber and the lower chamber was filled with the chemoattractant, causing the cells to migrate to the lower chamber. The inhibition activity was evaluated by counting the migrated cell numbers. Specifically, a titration of C5a was added to the bottom chamber a 96 transwell plate. Cells expressing human C5aR1 (C5aR1-U937 cells or human neutrophils) were incubated with or without antagonist and then seeded into the top chamber of the transwell plate. The cells were incubated for 2 hours. Cells that migrated to the bottom chamber were quantified using the CyQUANT cell proliferation kit following the manufacturer's protocol. The assay was performed using engineered cells stably expressing C5aR1 as well as using human neutrophils.

In a first experiment, C5aR1-U937 cells were seeded into the top chamber of a 96 Transwell plate in the presence of no antibody (antagonist), or of 1, 10, or 100 nM antibody (antagonist). The bottom chamber contained a half-log titration of C5a ranging from $10^{-6}$ to $10^{-9.5}$ M. As shown in FIGS. 8A-8F, the exemplary anti-C5aR1 antibodies generally inhibited cell chemotaxis in a dose-dependent manner, with the strongest effects detected for clones 11v2, 329, and 583.

In a second experiment, human neutrophils were seeded into the top chamber of a 96 Transwell plate in the presence of no antagonist, 1, 10, or 100 nM antagonist. The bottom chamber contained a half-log titration of C5a ranging from $10^{-6}$ to $10^{-9.5}$ M. As shown in FIGS. 9A-9D, the exemplary anti-C5aR1 antibodies generally inhibited human neutrophil chemotaxis in a dose-dependent manner, with the strongest effects detected for clone 329.

In a third setting, a combination of clones 66, 11, 329, 336v2, 583 and 322 were probed to detect inhibition of C5a induced chemotaxis. FIGS. 10A-10I show inhibition of chemotaxis with different combination of clones of anti-C5aR1 antibodies. It was observed that combination of Site I and Site II antibodies resulted in synergistic inhibition of chemotaxis.

Example 6: Functional Characterization of Anti-C5aR1 Antibody

This Example describes the calcium flux by C5aR1 antibodies in the presence of C5a.

Figures 11A, 11B, 11C:
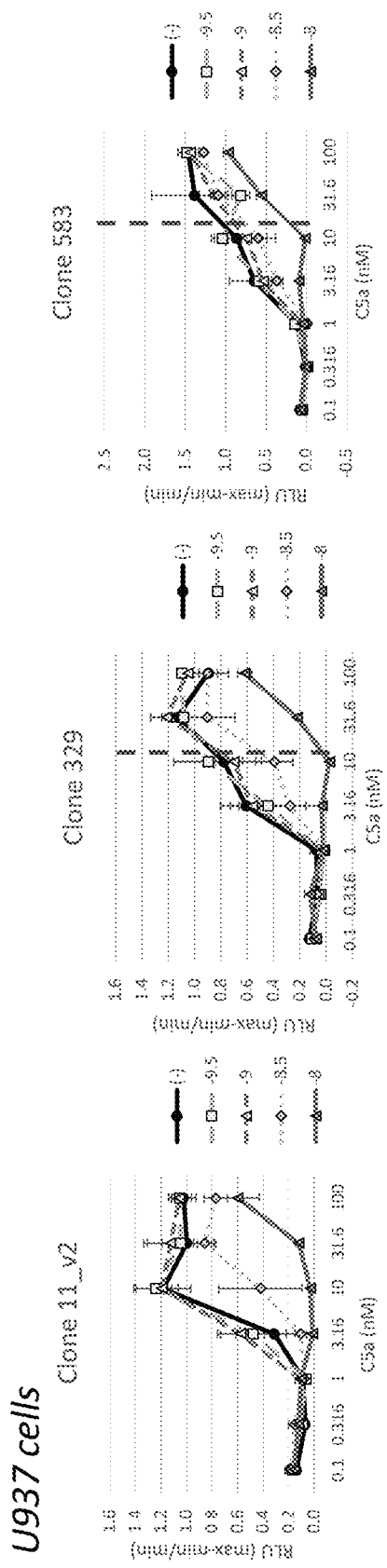
FIGS. 11A-11C are series of graphs showing C5aR1 inhibition of the C5a induced calcium efflux by C5aR1 antibodies in U937 cells—Clone 11v2 (FIG. 11A), Clone 329 (FIG. 11B), and Clone 583 (FIG. 11C).

Exemplary anti-C5aR1 antibody clone 329, generated as described in Example 1, was assessed for its ability to inhibit C5aR1 signaling Clones 11v2, 329, and 583 were tested for their ability to inhibit C5a induced calcium efflux. FIGS. 11A-11C show inhibition of the C5a induced calcium efflux by C5aR1 antibodies in U937 cells. FIGS. 12A-12C show inhibition of the C5a induced calcium efflux by C5aR1 antibodies in human neutrophils.

Figure 13B:
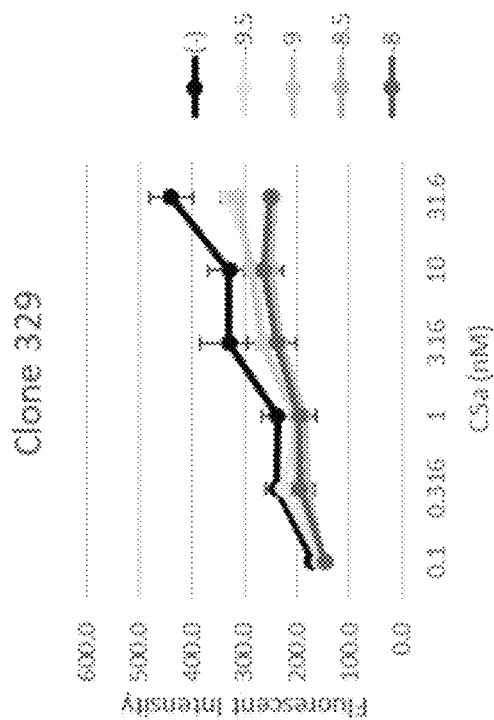
FIGS. 13A-13B are a series of graphs showing C5aR1 signaling inhibition in the GeneBLAzer assay by an exemplary anti-C5aR1 antibody (FIG. 13A), as well as inhibition of C5a-induced calcium flux in C5aR1-U937 cells by the same exemplary anti-C5aR1 antibody (FIG. 13B). −9.5, −9, −8.5 and −8 corresponds to $10^{-9.5}$M, $10^{-9.0}$ M, $10^{-8.5}$M and $10^{-8.0}$ M concentration of antibody 329.
Figure 13A:
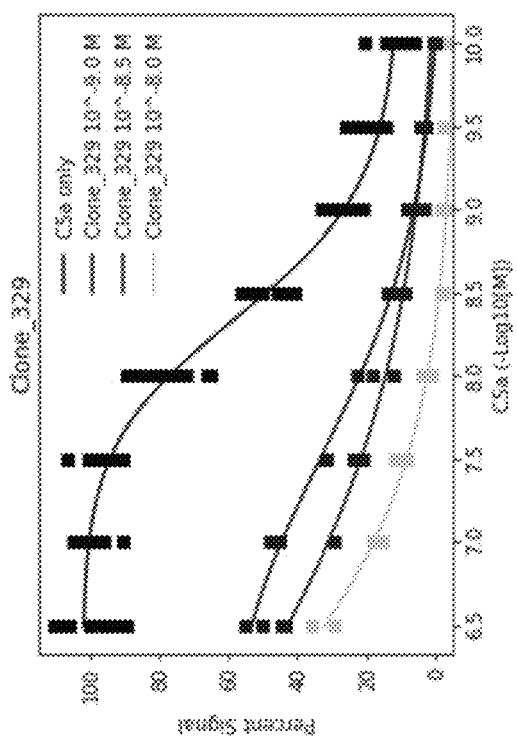

In one experiment, antibody 329 was examined in a GeneBLAzer assay as described in Example 1. As shown in FIG. 13A, C5aR1 signaling was inhibited in a dose-dependent fashion by antibody 329. In a second experiment, the ability of antibody 329 to inhibit C5a-induced calcium flux was measured in C5aR1-U937 cells. As shown in the bottom panel of FIG. 13B, C5a-induced calcium flux was inhibited by antibody 329 in a dose-dependent manner.

Example 7: Combination of Anti-C5aR1 Antibody with Small Molecule Inhibitor of C5aR1

Figure 14A:
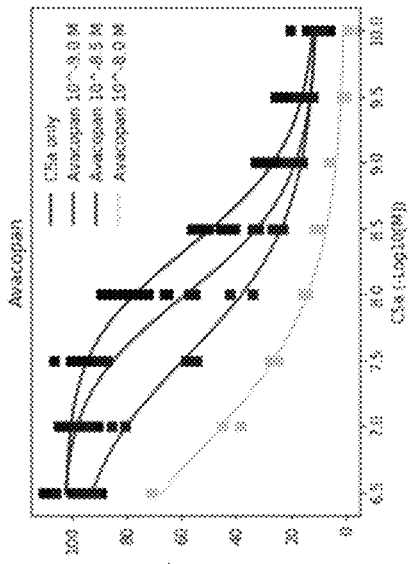
FIGS. 14A-14C are a series of graphs showing inhibition of C5aR1 signaling in the GeneBLAzer assay by antibody 329 (FIG. 14A), avacopan (FIG. 14B), or a combination of antibody 329 and avacopan (FIG. 14C).
Figure 14B:
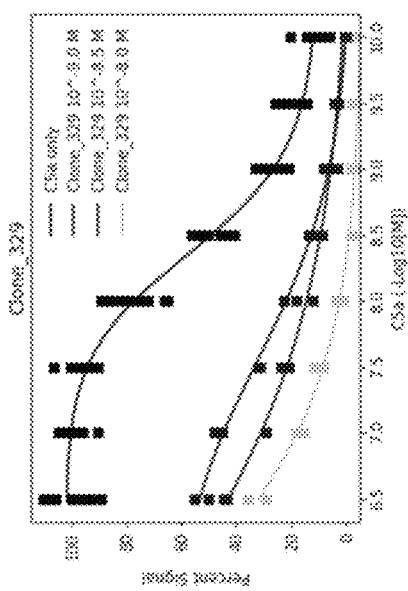
Figure 14C:
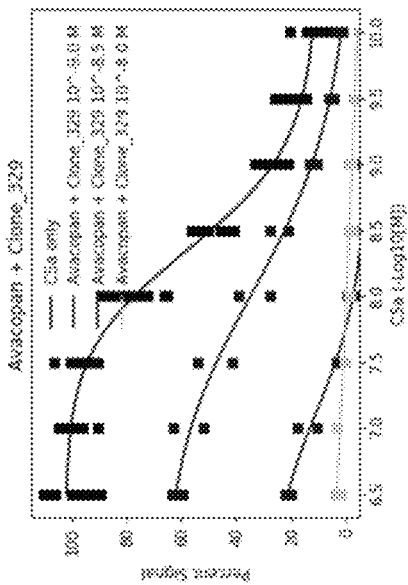

An exemplary anti-C5aR1 antibody targeting Site II, generated as described in Example 1 was tested in combination with Avacopan, an allosteric small molecule C5aR1 inhibitor. C5aR1 signaling was assessed using the GeneBLAzer assay, as described in Example 1. As shown in FIGS. 14A-14C, the combination of anti-Site II antibody 329 and Avacopan resulted in greater potency in blocking C5aR1 activity than Avacopan alone.

Example 8: Inhibition of Gα Signaling by Combination of Anti-C5aR1 Antibodies

This example describes inhibition of Gα signaling by combination of Site I and Site II antibodies and Site I-Site II biparatopic antibody in inhibition of C5a mediated Gα signaling.

Anti-C5aR1 antibodies targeting Site I and Site II (clone 583, clone 11, clone 329 and clone 336) were tested for inhibition of C5aR1 mediated Gα signaling using Gene BLAzer assay, as described in Example 4.

Figure 15A:
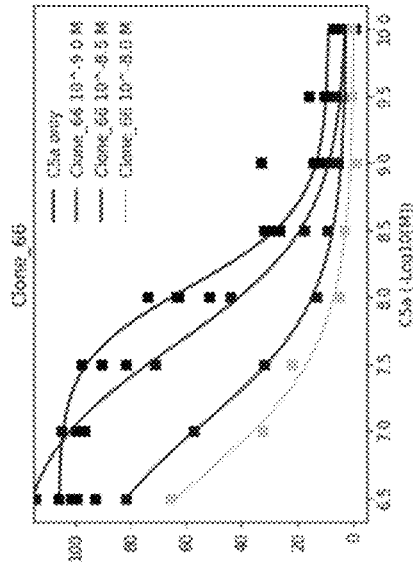
FIGS. 15A-15C are a series of graphs showing inhibition of C5aR1 signaling in the GeneBLAzer assay by antibody 329 (FIG. 15A), antibody 66 (FIG. 15B), or a combination of antibody 329 and antibody 66 (FIG. 15C).
Figure 15B:
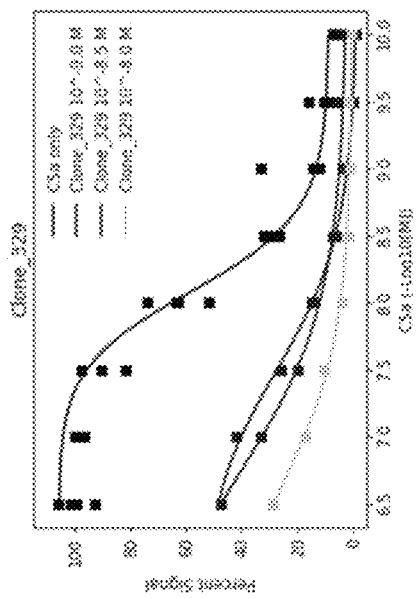
Figure 15C:
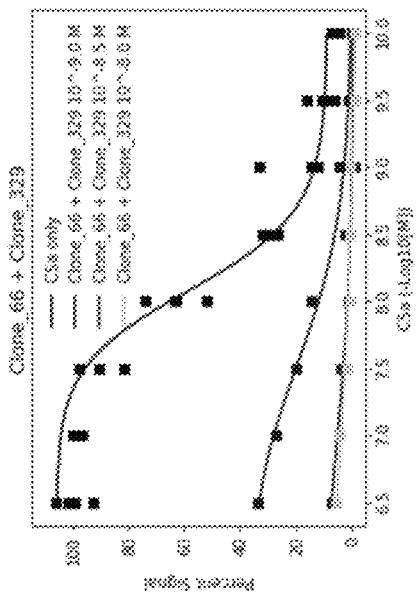

In a first setting, antibodies bind to Site I and Site II, respectively, were tested in the GeneBLAzer assay, as described in Example 1. As shown in FIGS. 15A-15C, the combination of anti-Site I antibody 66 and the anti-Site II antibody 329 resulted in greater potency in blocking C5aR1 activity than either antibody alone.

Figure 16A:
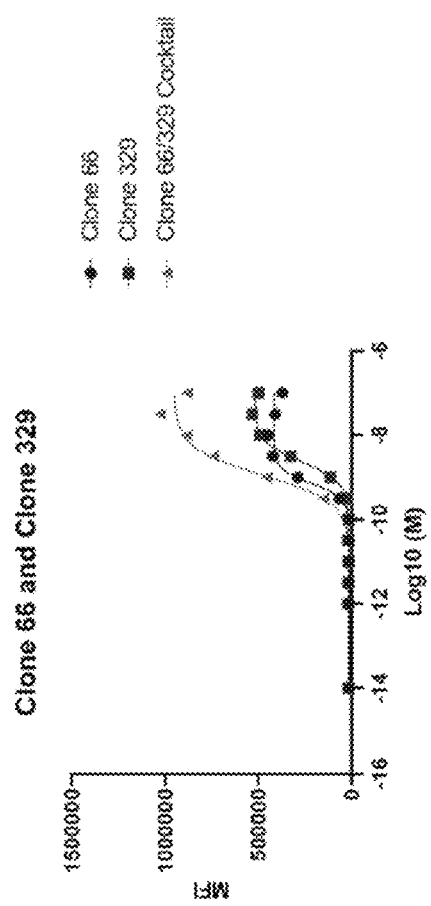
FIGS. 16A-16B are a series of graphs showing binding to cells expressing C5aR1 on their surfaces by the Site II antibody 329 either alone or in combination with a Site I antibody (either clone 66 (FIG. 16A); or clone 583 (FIG. 16B)). A HYHEL10 isotype control is included for comparison.
Figure 16B:
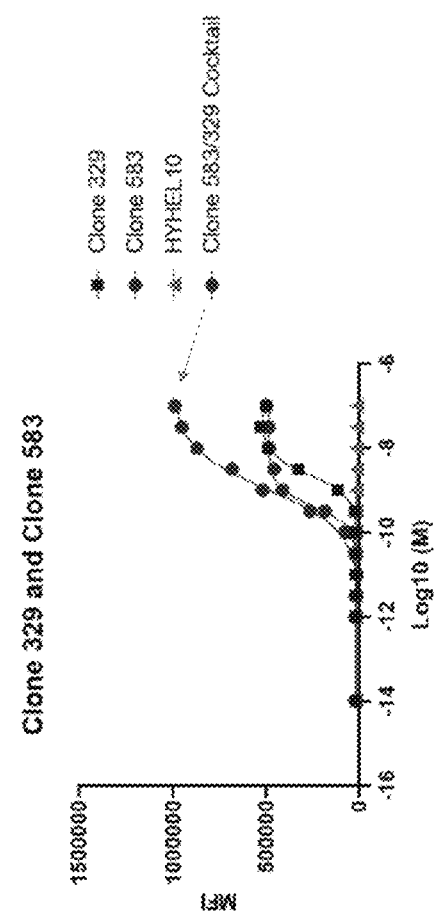

In a second experiment, Site II antibody 329 was tested in combination with each of the Site I antibodies 66 and 583 in a cell binding assay. Antibodies were assessed either as a single agent or in a combination of Site I and Site II antibodies in C5aR1-U937 cells. As shown in FIGS. 16A-16B, each combination of a Site I antibody with a Site II antibody resulted in an increase in the saturation level compared to the antibodies individually or an isotype control (HYHEL10), indicating that the combination of the Site I and Site II antibodies resulted in co-engagement of Site I and Site II of C5aR1.

In a third experiment, the combination of Site I and Site II antibodies was assessed for their capacity to inhibit calcium flux in C5aR1-U937 cells. As shown in FIGS. 17A-17C, the Site I antibody 66 and the Site II antibody 329 each inhibited calcium flux as single agents in a dose-dependent manner. The combination of antibodies 66 and 329 appeared to induce calcium flux inhibition to a greater degree than the single agents.

In a fourth experiment, the combination of Site I and Site II antibodies was assessed for their capacity to inhibit chemotaxis. As shown in FIGS. 18A-18C, the Site I antibody 583 and the Site II antibody 329 each inhibited chemotaxis as single agents in a dose-dependent manner.

In a fifth setting, an IgG4 scFv antibody comprising two different variable regions, capable of binding two different epitopes on C5aR1-first to Site I, the second to Site II were used to analyze for inhibition of C5aR1 mediated Gα signaling using GeneBLAzer assay. The scFv was linked to the heavy chain of the antibody. FIG. 19A-FIG. 19B show inhibition of C5aR1 mediated Gα signaling as a biparatopic antibody.

In a sixth setting, an IgG4 scFv antibody comprising two different variable regions, capable of binding two different epitopes on C5aR1-one to Site I, the second to Site II were used to analyze for inhibition of C5aR1 mediated Gα signaling using GeneBLAzer assay in U937 cells. The scFv was linked to the light chain of the antibody. FIG. 19C-FIG. 19E show inhibition of C5aR1 mediated Gα signaling as a biparatopic antibody.

Figures 20D, 20E:
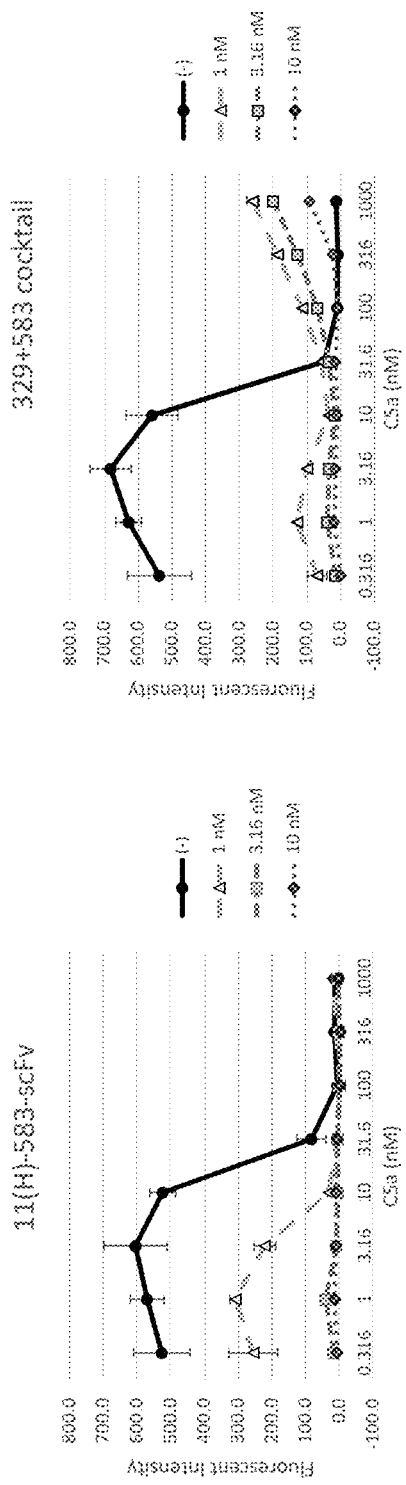
Figures 20F, 20G:
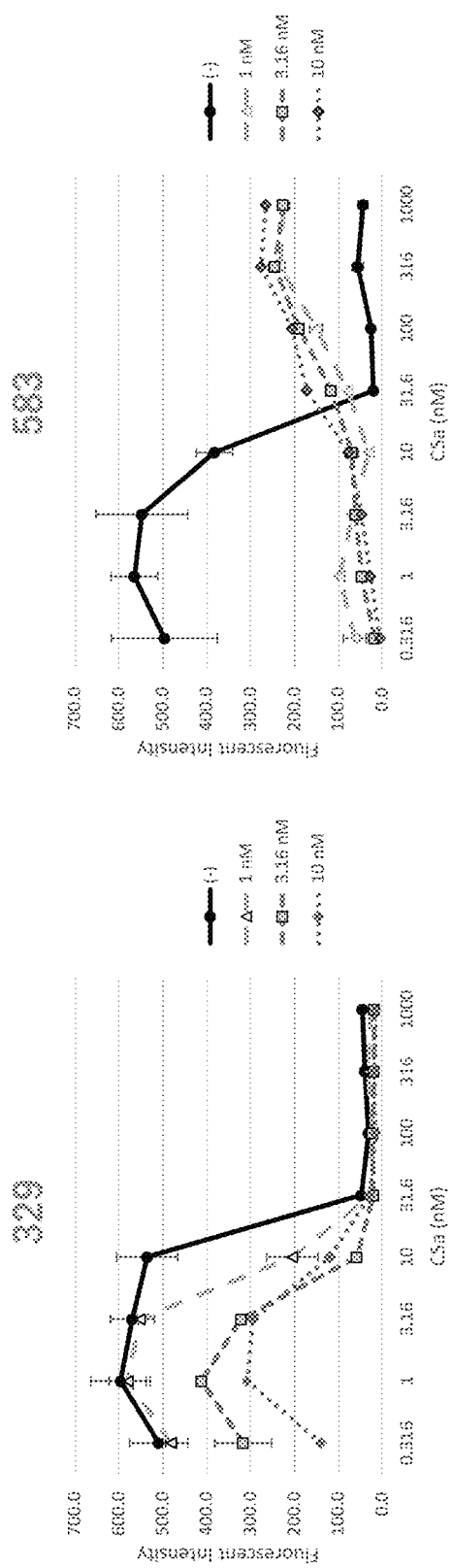

In a second setting, combination of clone 583 and clone 329 were analyzed for inhibition of C5aR1 mediated chemotaxis, in the presence of increasing concentrations of CS-alpha. FIG. 20E-FIG. 20G show inhibition of C5aR1 mediated chemotaxis as an antibody cocktail.

It was observed that biparatopic antibody and antibody cocktail targeted to site I and site II provided robust inhibition of C5aR1 mediated chemotaxis.

Example 10: In Vivo Inhibition of Neutropenia in Mice

This example describes method of inhibition of neutropenia in mice by anti-C5aR1 antibodies, in comparison with avacopan.

Human C5aR1 transgenic mice were obtained from Jackson Laboratories. The hC5aR1 mice were challenged with 100 µg/kg hC5a. The mice were treated with the antibodies at the indicated doses listed in Table 9.

TABLE 9

Dosages and antibodies for analyzing the effect of anti-C5aR1 antagonistic antibodies on Neutropenia in Mice. "bp" implies biparatopic.

| Group | N | Mice Strain | Test Article | Dose (mg/kg) | Route | Frequency | Blood Collection Time-points |
|---|---|---|---|---|---|---|---|
| 1 | 5 | C5a knock-in (hom × hom) | Avacopan | 30 mg/kg | PO | SD0 at −5 hr | SD0 at −5 min, 1 min, 5 min and T 2 hrs |
|   |   |   | C5a | 0.1 mg/kg | IV | SD0 at 0 hr |   |
| 2 | 5 | C5a knock-in (hom × hom) | 329 IgG4 | 20 mg/kg | IV | SD0 at −5 hr | SD0 at −5 min, 1 min, 5 min and T 2 hrs |
|   |   |   | C5a | 0.1 mg/kg |   | SD0 at 0 hr |   |
| 3 | 5 | C5a knock-in (hom × hom) | 583 IgG4 | 20 mg/kg | IV | SD0 at −5 hr | SD0 at −5 min, 1 min, 5 min and T 2 hrs |
|   |   |   | C5a | 0.1 mg/kg |   | SD0 at 0 hr |   |
| 4 | 5 | C5a knock-in (hom × hom) | 329-583 bp | 20 mg/kg | IV | SD0 at −5 hr | SD0 at −5 min, 1 min, 5 min and T 2hrs |
|   |   |   | C5a | 0.1 mg/kg |   | SD0 at 0 hr |   |
| 5 | 6 | C5a knock-in (hom × hom) | PBS | 10 mL/kg | IV | SD0 at −5 hr | SD0 at −5 min, 1 min, 5 min and T 2 hrs |
|   |   |   | C5a | 0.1 mg/Kg |   | SD0 at 0 hr |   |
| 6 | 6 | C5a knock-in (hom × hom) | PEG 400/ Solutol (70:30) | 10 mL/Kg | PO | SD0 at −5 hr | SD0 at −5 min, 1 min, 5 min and T 2 hrs |
|   |   |   | C5a | 0.1 mg/kg | IV | SD0 at 0 hr |   |

The combination of antibodies and the biparatopic antibody inhibited C5aR1 mediated Gα signaling, chemotaxis and calcium flux to a greater degree than the single agents.

Example 9: Inhibition of Chemotaxis by Anti-C5aR1 Biparatopic Antibodies

This example describes a method of inhibition of C5a chemotaxis using combination of Site I and Site II antibodies and Site I-Site II biparatopic antibody.

Anti-C5aR1 antibodies targeting Site I and Site II (clone 583, clone 11, clone 329 and clone 336) were tested for inhibition of C5aR1 mediated Gα signaling using Gene blaze assay, as described in Example 5, in U937 cells, in the presence of increasing concentrations of CS-alpha. In some embodiments, the biparatopic antibody comprised a scFv was linked to the light chain of the antibody (for example, 329(L)-583-scFv). In some embodiments, the biparatopic antibody comprised a scFv was linked to the heavy chain of the antibody (for example, 329(H)-583-scFv). FIG. 20A-FIG. 20E show inhibition of C5aR1 mediated Gα signaling as a biparatopic antibody.

Figure 21A:
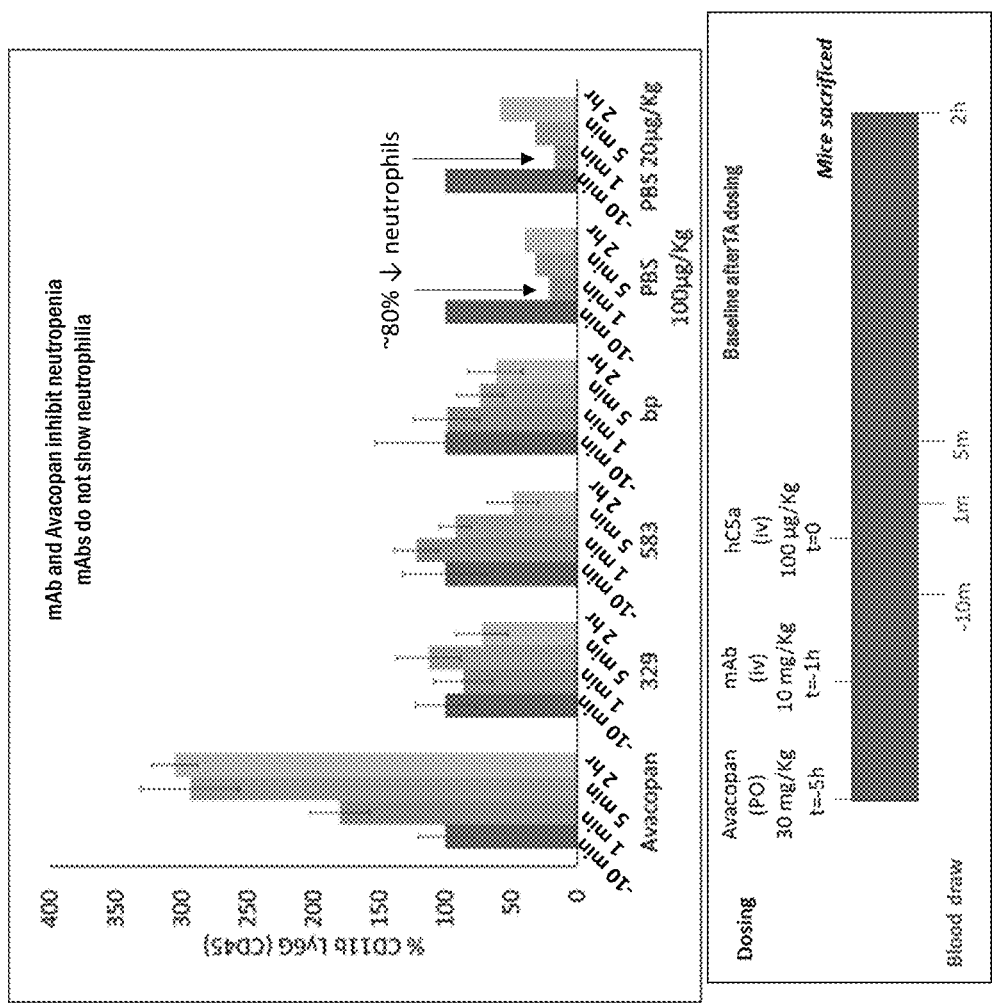
FIGS. 21A-21C are a series of graphs showing of C5aR1 mediated inhibition of CD11b expression in C5aR1 mice (Jackson Laboratories). Bp=biparatopic antibody.
Figure 21B:
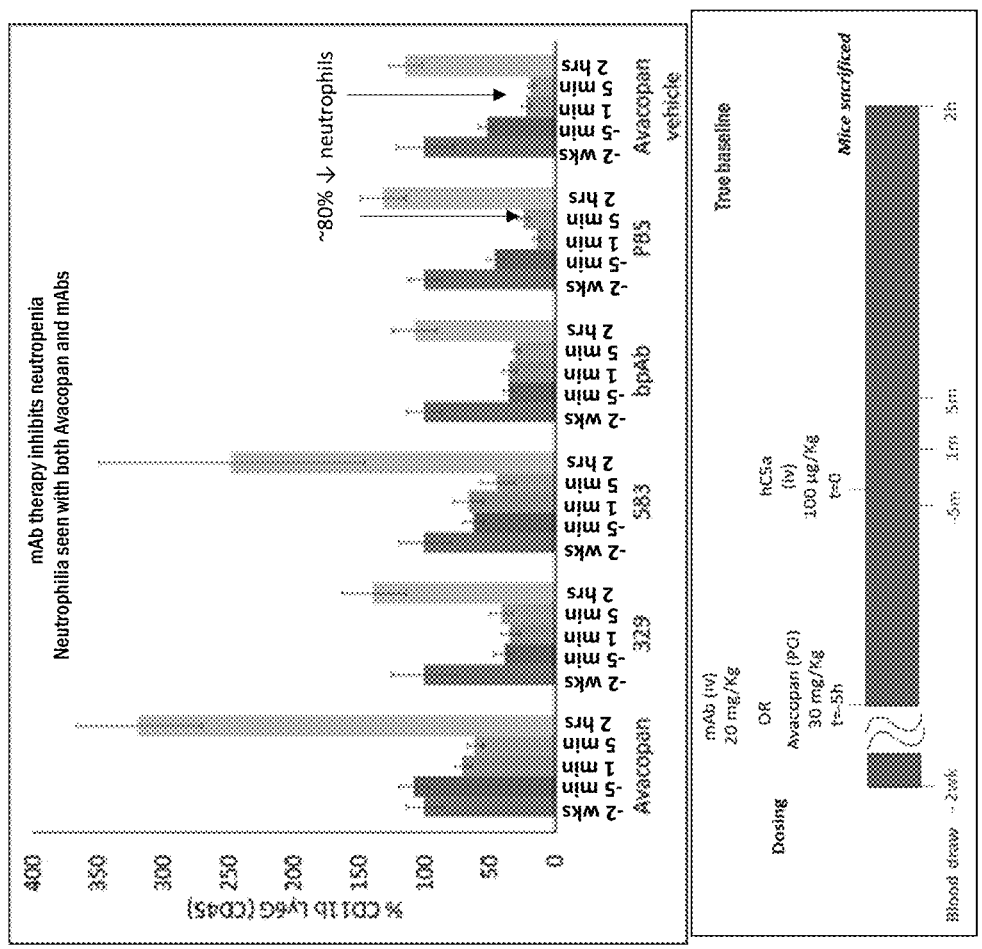
Figure 21C:
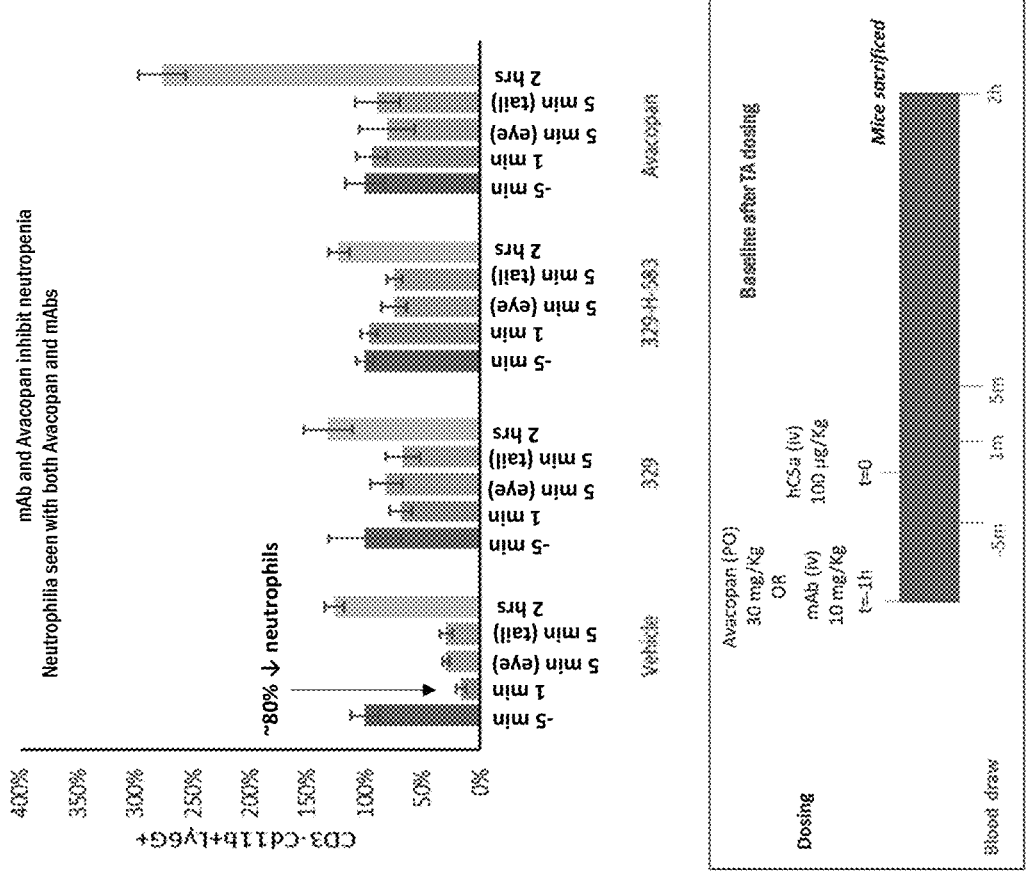

The blood was drawn before the injection of the antibodies and 1 min, 5 min and 2 hours after intravenous injection of the antibodies. FIG. 21A-21C shows the percent CD11b expression after injection of different antibodies. It was observed that neutropenia was decreased after injection of antibodies in mice.

Example 11: Biparatopic Anti-C5aR1 Antibodies

Figure 22A:
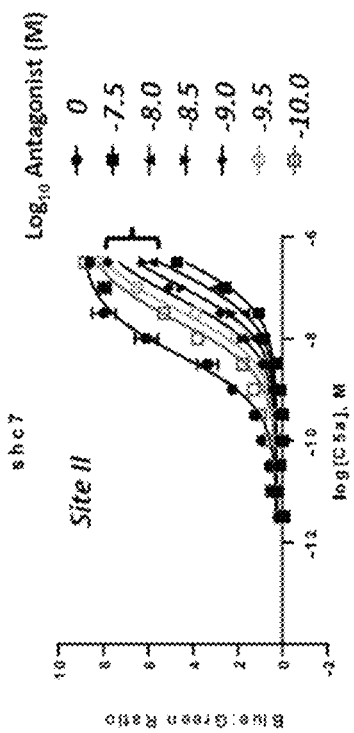
FIGS. 22A-22D are a series of graphs showing inhibition of C5aR1 signaling in the GeneBLAzer assay by the Site I-targeting antibody 3c5 (FIG. 22A), the Site II-targeting antibody shc7 (FIG. 22B), a combination of the two antibodies (FIG. 22C), or a biparatopic antibody comprising one antigen-binding domain from 3c5 and one antigen-binding domain from shc7 (FIG. 22D).
Figure 22B:
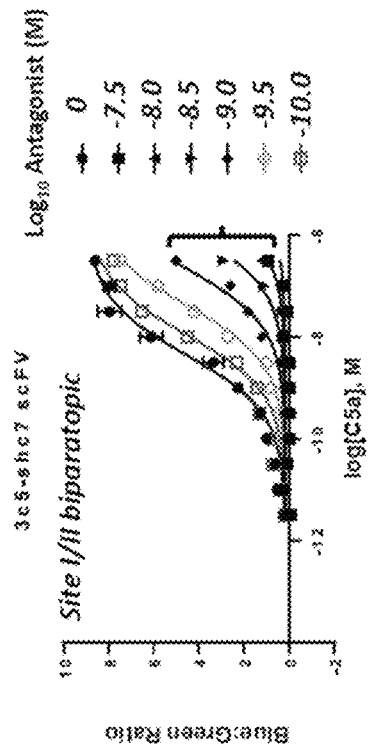
Figure 22C:
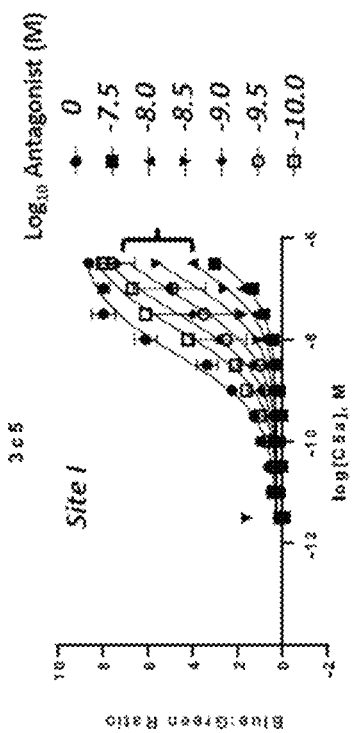
Figure 22D:
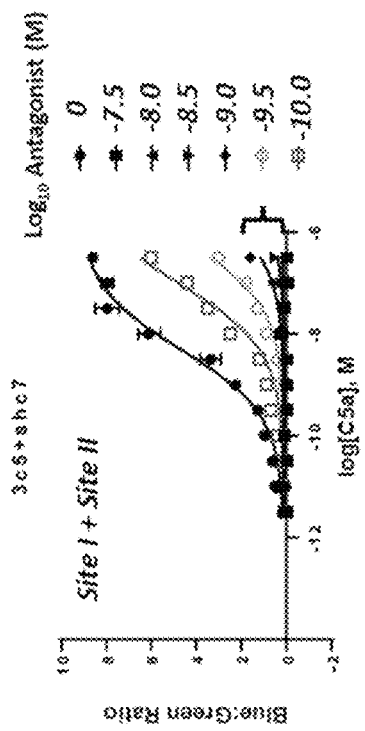

A combination of Site I antibodies and Site II antibodies, as well as a biparatopic antibody that engages Site I and Site II, were tested for functionality in comparison with standard monoclonal antibodies targeting C5aR1. The data from these experiments indicates that two full length IgG molecules can engage with C5aR1 at the same time. Further, a cocktail of Site I and Site II antibodies as well as a biparatopic antibody targeting site I and site II antibodies were more potent at blocking C5aR1 signaling than the parental mAbs (FIGS. 22A-22C). A biparatopic antibody targeting site I and site II antibodies were more potent at blocking C5aR1 signaling than the parental mAbs (FIGS. 22A-22B and 22D). This improvement in potency was not observed when two site I or two site II antibodies were used. Therefore, the data indicates that a Site I-Site II directed biparatopic antibody would be a more potent inhibitor of C5aR1 signaling than a monospecific antibody targeting one site.

INCORPORATION BY REFERENCE

All publications, patents, and Accession numbers mentioned herein are hereby incorporated by reference in their entirety as if each individual publication or patent was specifically and individually indicated to be incorporated by reference.

EQUIVALENTS

While specific embodiments of the subject invention have been discussed, the above specification is illustrative and not restrictive. Many variations of the invention will become apparent to those skilled in the art upon review of this specification and the claims below. The full scope of the invention should be determined by reference to the claims, along with their full scope of equivalents, and the specification, along with such variations.

SEQUENCE LISTING (1475 sequences)

SEQ ID NO: 1 - protein, 122 aa, Artificial Sequence
  source: /note="Description of Artificial Sequence: Synthetic polypeptide"
QVQLQQSGPELVKPGASVKISCKASGYSFSSSWMNWVKQRPGKGLEWIGRISPGDGDTRYSGKFKGKATLTADKSSSTAYMQVTSLTSEDSAIYFCVRRFLITSTRYVMDYWGQGTTVTVSS

SEQ ID NO: 2 - protein, 121 aa, Artificial Sequence
  source: /note="Description of Artificial Sequence: Synthetic polypeptide"
QVQLQQSGPELVKPGASVKISCKASGYSFSSSWMNWVKQRPGKGLEWIGRISPGDGDTRYSGKFKGKATLTADKSSSTAYMQVTSLTSEDSAIYFCVRFLITSTRYVMDYWGQGTTVTVSS

SEQ ID NO: 3 - protein, 123 aa, Artificial Sequence
  source: /note="Description of Artificial Sequence: Synthetic polypeptide"
QVQLQQSDAELVKPGASVKISCKASGYTFIDHAIHWVKQRPEQGLEWIGYISPGNGEIKYNEKFKAKATLTADKSSSAAYMQLNSLTSADSAVYFCKRALFYYTGKYQPMDYWGQGTTVTDSS

SEQ ID NO: 4 - protein, 119 aa, Artificial Sequence
  source: /note="Description of Artificial Sequence: Synthetic polypeptide"
QVQLKESGPGLVAPSQSLSITCTVSGFSLTSYAISWVRQPPGKGLEWLGVIWTGGGTKYNSALKSRLSISKDNSKSHVFLKMNSLQSDDTARYYCARDGDYVYYAMAYWGQGTTVTVSS

SEQ ID NO: 5 - protein, 113 aa, Artificial Sequence
  source: /note="Description of Artificial Sequence: Synthetic polypeptide"
QVQLQQSGAELVKPGASVKISCKASGYAFSRYWMNWVKQRPGKGLEWIGQIYPGDGDTKYNGKFKGKATLTADKSSSTAYMQLNSLTSEDSAVYFCTRSLGVWGTGTTVTVSS

SEQ ID NO: 6 - protein, 117 aa, Artificial Sequence
  source: /note="Description of Artificial Sequence: Synthetic polypeptide"
QIQLVQSGPELKKPGETVKISCKASGYSFTTFGMSWVKQAPGKVLKWMGWINTYSGVPTYADDFKGRFAFSLETSASTAYLQINNLKNEDTATYFCARGLGRLLAYWGQGTLVTVSA

SEQ ID NO: 7 - protein, 113 aa, Artificial Sequence
  source: /note="Description of Artificial Sequence: Synthetic polypeptide"
QVQLQQSGAELVKPGASVKISCKASGYAFSSYWMNWVKQRPGKGLEWIGHIYPGDGDTKYNGKFKGKATLTADKSSSTAYMQVSSLTSEDSAVYFCTRSLGVWGTGTTVTVSS

SEQ ID NO: 8 - protein, 116 aa, Artificial Sequence
  source: /note="Description of Artificial Sequence: Synthetic polypeptide"
QVQLQQSGAELAKPGASVKMSCKASGYTFTSYWMHWVKQRPGQGLEWIGYINPSSGYTEYNQKFKDKATLTADKSSSTAYMQLSSLTSEDSAVYYCARGMFAMDYWGQGTTVTVSS

SEQ ID NO: 9 - protein, 112 aa, Artificial Sequence
  source: /note="Description of Artificial Sequence: Synthetic polypeptide"
QVQLQQPGAELVMPGASVKLSCKASGYTFTSYWLHWVRQRPGQGLEWIGEIDPSDGYSNHNQKFKGKATLTVDKSSSTAYMQLSSLTSEDSAVYYCATEGFWGQGTTVTVSS

SEQ ID NO: 10 - protein, 121 aa, Artificial Sequence
  source: /note="Description of Artificial Sequence: Synthetic polypeptide"
QVQLQQPGAELVMPGASVKLSCKASGYTFTSYWMHWVKQRPGQGLEWIGEIDPSDSYTNYNQKFKGKATLTVDKSSSTAYMQLSSLTSEDSAVYYCARVAYYSNFGGFAYWGQGTTVTVSS

SEQ ID NO: 11 - protein, 123 aa, Artificial Sequence
  source: /note="Description of Artificial Sequence: Synthetic polypeptide"
QVQLQQSDAALVKPGASVKISCKASGHTFTDHAIHWVKQRPEQGLEWIGYISPGNGDIKYNDKFKGKATLTADKSSSTAYMQLNSLTPEDSAVYFCKGPLFVRGQYYITMDYWGQGTTVTVSS

SEQ ID NO: 12 - protein, 123 aa, Artificial Sequence
  source: /note="Description of Artificial Sequence: Synthetic polypeptide"
QVQLQQSGAELTKPGASVKLSCKASGYTFTNYWMHWVKQRPGQGLEWIGYLNPSSGYTKYNQKFKDKATLTADKSSSTAYMQLNSLTYEDSAVYYCTRSGGDNYGNPYYFDRWGQGTTVTVSS

SEQ ID NO: 13 - protein, 118 aa, Artificial Sequence
  source: /note="Description of Artificial Sequence: Synthetic polypeptide"
QVQLKQSGPGLVQPSQSLSIACTVSGFSLTSYGVHWVRQSPGKGLEWLGVIWRGGSTDYNAAFKSRLSITKDNSKSQVFFTMNRLHADDTAIYYCAKNSQLGNAMDYWGQGTTVTVSS

SEQ ID NO: 14 - protein, 123 aa, Artificial Sequence
  source: /note="Description of Artificial Sequence: Synthetic polypeptide"
QVQLQQSDAELVKPGASVKISCKASGYTFTDHSIHWVKQRPEQGLEWIGYISPGNGDIKYDEKFKGKATLTADTSSSTAYMQLNSLTSEDSAVYFCKGPLLLRWRYFYPVDYWGQGTTVTVSS

SEQ ID NO: 15 - protein, 123 aa, Artificial Sequence
  source: /note="Description of Artificial Sequence: Synthetic polypeptide"
QVQLQQSDAALVKPGASVKISCKASGYTFTDHAIHWVKQRPEQGLEWIGYISPGNGDIKYNEKFKGKATLTADKSSSTAYMQLNSLTSEDSAVYFCKGPLLVRWRYYITMDYWGQGTTVTVSS

SEQ ID NO: 16 - protein, 119 aa, Artificial Sequence
  source: /note="Description of Artificial Sequence: Synthetic polypeptide"
EVKLEESGGGLVQPGGSMKLSCAASGFTFSDAWMDWVRQSPEKGLEWVAEIRNKANNHATYYAESVKGRFTISRDDSKSSVYLQMNSLRAEDTGIYYCTRGGYYVFAYWGQGTTVTVSS

SEQ ID NO: 17 - protein, 118 aa, Artificial Sequence
  source: /note="Description of Artificial Sequence: Synthetic polypeptide"
QVQLKQSGPGLVQSSQSLSITCTVSGFSLISYGVHWVRQSPGKGLEWLGVIWSGGSTDYNAAFKSRLSITKDNSKSQVFFKMNSLQADDTAIYYCAKNSQLGNAMDYWGQGTTVTVSS

SEQ ID NO: 18 - protein, 117 aa, Artificial Sequence
  source: /note="Description of Artificial Sequence: Synthetic polypeptide"
QVQLQQPGAELVKPGASVKLSCKASGYTFTSYWMHWVKQRPGQGLEWIGMIHPNSNSTNYNEKFKSKATLTVDKSSSTAYMQLSSLTSEDSAVYYCARSLTGTKTYWGQGTTVTVSS

SEQ ID NO: 19 - protein, 116 aa, Artificial Sequence
  source: /note="Description of Artificial Sequence: Synthetic polypeptide"
EVQLQQSGPELVKPGASVKMSCKASGYTFTDYNMHWVKQSHGKSLEWIGYINPNNGGTSYNQKFKGKATLTVNKSSSTAYMELRSLTSEDSAVYYCAHGEGDYAYWGQGTTVTVSS

SEQ ID NO: 20 - protein, 115 aa, Artificial Sequence
  source: /note="Description of Artificial Sequence: Synthetic polypeptide"
EFQLQQSGPELVKPGASVKMSCKASGYTFTKYVIHWVKQKPGQGLEWIGYINPYNDGTKYNEKFKGKARLTSDKSSNTVYMDLSSLTSEDSAVYYCATARATSYWGQGTTVTVSS

SEQ ID NO: 21 - protein, 117 aa, Artificial Sequence
  source: /note="Description of Artificial Sequence: Synthetic polypeptide"
QVQLQQPGAEFVKPGASVKMSCKASGYSFTSYWITWLKQRPGQGLEWIGDIYPGRGTTDYNEKLKSRATLTVDTSSTTAYMQLSSLTSEDSAVYYCARWGTTGRSYWGQGTTVTVSS

SEQ ID NO: 22 - protein, 121 aa, Artificial Sequence
  source: /note="Description of Artificial Sequence: Synthetic polypeptide"
QVQLQQSGAELVKPGASVKLSCKASGYTFTEYTIHWVNQRSGQGLEWIGWFYPGSGSIKYNEKFKDKATLTADKSSHTVYMELSRLTSEDSAVYFCARHGNYYDGSWFAYWGQGTLVTVSA

SEQ ID NO: 23 - protein, 120 aa, Artificial Sequence
  source: /note="Description of Artificial Sequence: Synthetic polypeptide"
EVQLVESGGDLVKPGGSLKLSCAASGFTFSNYGMSWVRQTPDKRLEWVATITSGGTHTYYPDSVKGRFTISRDNAKNTLYLQMSSLKSEDTAMYYCTRHGAYYSNPWFAYWGQGTLVTVS

SEQ ID NO: 24 - protein, 114 aa, Artificial Sequence
  source: /note="Description of Artificial Sequence: Synthetic polypeptide"
QIQLVQSGPELKKPGETVKISCKASGYTFTTFGMSWVKQAPGKGLKWMGWINTNSGMPTYTDDFRGRFAFSLETSASTAYLQISSLKNEDTATYFCARKSLFYWGQGTTLTVSS

SEQ ID NO: 25 - protein, 121 aa, Artificial Sequence
  source: /note="Description of Artificial Sequence: Synthetic polypeptide"
QVQLQQSGAELAKPGASVKLSCKASGYTFISYWMHWVKQRPGQGLEWIGYINPRSDYAKYNQKFKDKATLTTNKSSSTAYMQLSSLTYEDYAVYYCARVTGTEGPYYFDYWGQGTTLTVSS

SEQ ID NO: 26 - protein, 121 aa, Artificial Sequence
  source: /note="Description of Artificial Sequence: Synthetic polypeptide"
QVQLQQSGAELAKPGASVKLSCKASGYTFSSYWIHWVKQRPGQGLEWIGYINPRGDYTKYNQKFKDKATLTADKSSSTAFMQLSSLTYEDSAVYYCVRVTGSEGPYYFDYWGQGTTLTVSS

SEQ ID NO: 27 - protein, 121 aa, Artificial Sequence
  source: /note="Description of Artificial Sequence: Synthetic polypeptide"
QVQLQQSGADLAKPGASVKLSCKASGYTFTSYWIHWVKQRPGQGLEWIGYINPRGDYTKYNQKFKDKATLTADRSSSTAYMQLSSLTYEDYAVYYCARVTGTEGPYYFDYWGQGTTLTVSS

SEQ ID NO: 28 - protein, 118 aa, Artificial Sequence
  source: /note="Description of Artificial Sequence: Synthetic polypeptide"
QIQLVQSGPELKKPGETVKISCKASGYTFTAYGMSWVKQTPGKGLKWMGWINTYSGVPANADDFKGRFAFSLETSASTAYLQINNLKNEDTATYFCARSRYDGYFDYWGQGTTLTVSS

SEQ ID NO: 29 - protein, 118 aa, Artificial Sequence
  source: /note="Description of Artificial Sequence: Synthetic polypeptide"
QVQLKQSGPGQVAPSQSLSITCTVSGFSLINSAVHWVRQSPGKGLEWLGVIWSDGSTDYNTAFISRLSISRDNSKSQVFFKMRSLQVDDTAVYYCARNGRLGNAMDYWGQGTSVTVSS

SEQ ID NO: 30 - protein, 119 aa, Artificial Sequence
  source: /note="Description of Artificial Sequence: Synthetic polypeptide"
QVQLKQSGPGLVAPSQSLSITCTVSGFSLTSYGVDWIRQSPGKGLEWLGVIWGVGSTNYNSALKSRLSISKDNSRSQVFLKLNSLQTDDTAMYYCASPYYSHYVPFAYWGQGTLVTVSA

SEQ ID NO: 31 - protein, 120 aa, Artificial Sequence
  source: /note="Description of Artificial Sequence: Synthetic polypeptide"
QVQLQQSGAELAKPGASVKLSCKASGYIFTSYWMNWVKQRPGQGLEWIGYINPSTTSTKYNQKFKDKATLTADKSSTTAYMQLTSLTYEDSAVYYCARPDNSGYVGFAYWGQGTLVTVSA

SEQ ID NO: 32 - protein, 119 aa, Artificial Sequence
  source: /note="Description of Artificial Sequence: Synthetic polypeptide"
QVQLKQSGPGLVAPSQSLSITCTVSGFSLTSYGVDWIRQSPGKGLEWLGVIWGVGGTNYNSALKSRLSISKDNSRSQVFLKLNSLQTDDTAMYYCASPYYSHYVPFAYWGQGTLVTVSA

SEQ ID NO: 33 - protein, 116 aa, Artificial Sequence
  source: /note="Description of Artificial Sequence: Synthetic polypeptide"
QVQLQQSGAELAKPGASVQVSCKASGYSFTRYWMHWIKQRPGQGLEWIGYINPSTDYSAYNQKFKDKATLTADKSSSTAYLQLTSLTSEDSAVYYCAGGLPHFDYWGQGTTLTVSS

SEQ ID NO: 34 - protein, 118 aa, Artificial Sequence
  source: /note="Description of Artificial Sequence: Synthetic polypeptide"
QVQLKQSGPGLVAPSQSLSITCTVSGFSLTTYGVHWVRQPPGKGLEWLVVIWSDGSTTYNSALKSRLSISKDNSKSQVFLKMNSLQPDDTAMYYCARNSRYGNSFAYWGQGTLVTVSA

SEQ ID NO: 35 - protein, 115 aa, Artificial Sequence
  source: /note="Description of Artificial Sequence: Synthetic polypeptide"
DVQLQESGPDLVKPSQSLSLTCTVTGYSITSGYSWHWIRQFPGNKLEWMGYIHYSGSTNYNPSLKSRISITRDTSKNQFFLQLKSVTTEDTATYYCVFWLPFDYWGQGTTLTVSS

SEQ ID NO: 36 - protein, 119 aa, Artificial Sequence
  source: /note="Description of Artificial Sequence: Synthetic polypeptide"
DVQLQESGPGLVKPFQSLSLTCTVTGYSITSDYAWNWIRQFPGNKLEWMGYINYSGSTSYNPSLRSRISITRDTSKNQFFLHLNSVTTEDTATYYCARMGYRYPWFAYWGQGTLVTVSA

SEQ ID NO: 37 - protein, 119 aa, Artificial Sequence
  source: /note="Description of Artificial Sequence: Synthetic polypeptide"
EVQLKQSGGGLVKPGGSLKLSCAASGFTFSSYTMSWVRQTPEKRLEWVATISSGGSYTYYPDSVKGRFTISRDNAKNTLYLQMSSLKSEDTAMYYCTRGGGNYDAMDYWGQGTSVTVSS

SEQ ID NO: 38 - protein, 125 aa, Artificial Sequence
  source: /note="Description of Artificial Sequence: Synthetic polypeptide"
QVQLQQSGAELAKPGASVKLSCKASGYTFTNYWMHWVKQRPGQGLEWIGYINPSSASSKYNQKFKDRATLTTDKSSSTAFMHLSSLTYEDSAVYYCARVPLPYGSSYGPYFFDFWGQGTTLTVSS

SEQ ID NO: 39 - protein, 118 aa, Artificial Sequence
  source: /note="Description of Artificial Sequence: Synthetic polypeptide"
QVQLQQSGAELARPGASVKMSCKASGYTFTSYTMHWVKQRPGQGLEWIGYINPSSGYTKYNQKFKDKATLTADKSSSTAYMQLSSLTSEDSAVYYCARSGDYDGFAYWGQGTLVTVSA

SEQ ID NO: 40 - protein, 125 aa, Artificial Sequence
  source: /note="Description of Artificial Sequence: Synthetic polypeptide"
QVQLQQSGAELAKPGASVKLSCKASGYTFTSYWMHWVKQRPGQGLEWIGYINPSSGYTKYNQKFKDRATLTADKSSSTAYMQLSSLTYEDSAVYYCARVPLSYGSSYGPYFFDYWGQGTTLTVSS

SEQ ID NO: 41 - protein, 125 aa, Artificial Sequence
  source: /note="Description of Artificial Sequence: Synthetic polypeptide"
QVQLQQSGAELAKPGASVKLSCKTSGYTFTNYWMHWIKQRPGLGLEWIGYINPSGDYTKHNQKFKDKATLTADRSSSTAYMQLSSLTYEDSAVYYCARVPLSYGSGNGPYYFDYWGQGTTLTVSS

SEQ ID NO: 42 - protein, 125 aa, Artificial Sequence
  source: /note="Description of Artificial Sequence: Synthetic polypeptide"
QVQLQQSRAALAKPGASVKLSCKASGYTFTNHWMHWVKQRPGQGLEWIGYINPINGFNRYNQNFKDRATLTTDKASSTAFIHLNGLTYEDFAVYYCARVPLSYGGSYGPYFFDFWGQGTILTVSS

SEQ ID NO: 43 - protein, 125 aa, Artificial Sequence
  source: /note="Description of Artificial Sequence: Synthetic polypeptide"
QVQLQQSRAALAKPGASVKLSCKASGYTFTNHWLHWVKQRPGQGLEWIGYINPINGFSKYNQNFKNRATLTTDSSSSTAFIHLSGLTYEDFAVYYCARVPLSYGGSYGPYFFDFWGQGTILTVSS

SEQ ID NO: 44 - protein, 125 aa, Artificial Sequence
  source: /note="Description of Artificial Sequence: Synthetic polypeptide"
QVQLQQSGAALAKPGASVKLSCKASGYSFTNYWMHWVKQRPGQGLEWIGYINPINGYGKYNQNFKDRATLTTDKSSSTAFIHLSGLTYEDSAVYYCARVPLSYGGSYGPYFFDFWGQGTILTVSS

SEQ ID NO: 45 - protein, 116 aa, Artificial Sequence
  source: /note="Description of Artificial Sequence: Synthetic polypeptide"
QVQLQQSGPELVKPGESVKMSCKASGYTFTDYYMDWVKQSHGKSLEWIGYFYPNNGGVKYSQKFKDKAALTVDKSSTTAYMELHSLTFEDSAVYYCTRGSGPFAYWGQGTLVTVSA

SEQ ID NO: 46 - protein, 119 aa, Artificial Sequence
  source: /note="Description of Artificial Sequence: Synthetic polypeptide"
QVQLKQSGPGLVAPSQSLSITCTVSGFSLTNYGVDWVRQSPGKGLEWLGVIWGDGITKYNSALKSRLSISKDNSKSQVFLKMNSLQTDDTAMYYCASALDYSNYGFAYWGQGTLVTVSA

SEQ ID NO: 47 - protein, 116 aa, Artificial Sequence
  source: /note="Description of Artificial Sequence: Synthetic polypeptide"
QVQLQQSGPELVKPGDSVKMSCKVSGYTFTDYYIDWVKQSHGKSLEWIGYFYPNNGGAKYNQKFKSKAALTVDKSSTTAYMELHSLTFEDSAVYYCTRGSGPFAYWGQGTLVTVSA

SEQ ID NO: 48 - protein, 119 aa, Artificial Sequence
  source: /note="Description of Artificial Sequence: Synthetic polypeptide"
QVQLKQSGPGLVAPSQSLSITCTVSGFSLTNCGVDWVRQSPGKSLEWLGVIWGDGLTKYNSALKSRLSISKDNSKSQVFLKVNSLQTDDTAVYYCASALDYSNYGFAYWGQGTLVTVSA

SEQ ID NO: 49 - protein, 116 aa, Artificial Sequence
  source: /note="Description of Artificial Sequence: Synthetic polypeptide"
QVQLQQSGPELVKPGDSVKMSCKASGYTFTDYYMDWVKQSHGKSLEWIGYFYPNNGGAKYNQKFKGKAALTVDKSSTTAYMELHSLTFEDSAVYYCTRGSGPFAYWGQGTLVTVSA

SEQ ID NO: 50 - protein, 119 aa, Artificial Sequence
  source: /note="Description of Artificial Sequence: Synthetic polypeptide"
QVQLKQSGPGLVAPSQSLSITCTVSGFSLTNCGVDWVRQSPGKSLEWLGVIWGDGLTKYNSALKSRLSISKDNSKSQVFLKVNRLQTDDTAMYYCASALDYSNFGFAYWGQGTLVTVSA

SEQ ID NO: 51 - protein, 116 aa, Artificial Sequence
  source: /note="Description of Artificial Sequence: Synthetic polypeptide"
QVQLQQSGPELVKPGDSVKMSCKASGYTFSDYYMDWVKQSHGKSLEWIGYFYPNNDGIRYNQRFKGRASLTVDKSSNTAYMELHSLTSEDSAVYYCARGSGPFVYWGQGTLVTVSA

SEQ ID NO: 52 - protein, 116 aa, Artificial Sequence
  source: /note="Description of Artificial Sequence: Synthetic polypeptide"
DVQLQESGPGLVKPSQSLSLTCTVTGYSITSDSAWNWIRQFPGNKLEWMGYISYSGRISYNPSLKSRISITRDTSKNQFFLQFNSVTTEDTAKYYCARASIGFDYWGQGTTLTVSS

SEQ ID NO: 53 - protein, 119 aa, Artificial Sequence
  source: /note="Description of Artificial Sequence: Synthetic polypeptide"
EVQLQQSGADLVKPGASVKLSCTVSGFNIKDSYIHWLKQRPGQGLEWIGRIDPTNVNTKYDPKFQGKASITTDTSSNTAYLQLSSLTSENTAVYYCARRLRQTYAMDYWGQGTSVTVSS

SEQ ID NO: 54 - protein, 116 aa, Artificial Sequence
  source: /note="Description of Artificial Sequence: Synthetic polypeptide"
DVQLQESGPGLVKPSQSLSLTCTVTGYSITSDSAWNWIRQFPGNKLEWMGYISYSGRISYNPSLKSRISITRDTSKNQIFLQFNSVTTEDTAKYYCARASIGFDYWGQGTTLTVSS

SEQ ID NO: 55 - protein, 116 aa, Artificial Sequence
  source: /note="Description of Artificial Sequence: Synthetic polypeptide"
DVQLQESGPGLVKPSQSLSLTCTVTGYSITSDSAWNWIRQFPGNKLEWMGYISYSGRISYNPSLKSRISITRDTSKNQFFLQFYSVTTEDTARYYCARASIGFDYWGQGTTLTVSS

SEQ ID NO: 56 - protein, 117 aa, Artificial Sequence
  source: /note="Description of Artificial Sequence: Synthetic polypeptide"
EVQLVESGGGLVKPGGSLKLSCAASGFTFNAYAMSWVRQTPEKRLEWVASISTGGNTYCPDSVKDRFTVSRDNVRNILYLQMSSLRSEDTAMYYCTRGYQRFSGFAYWGQGTLVTVS

SEQ ID NO: 57 - protein, 114 aa, Artificial Sequence
  source: /note="Description of Artificial Sequence: Synthetic polypeptide"
DVQLQESGPDLVKPSQSLSLTCTVTGYSITSGYSWHWIRQSPGNKLEWLAYIHNSGSTNYNPSLKSRISITRDTSKNQFFLKLNSVTTEDTATYYCARSIGDYWGQGTTLAVSS

SEQ ID NO: 58 - protein, 121 aa, Artificial Sequence
  source: /note="Description of Artificial Sequence: Synthetic polypeptide"
DVQLQESGPGLVKPSQSLSLTCTVTGYSITSDYAWNWIRQFPGNKLEWMGYISYSGSTSYNPSLKSRISITRDTSKNQFFLQLSSVTTEDTATYYCARYGGNYPTYAMDYWGQGTSVTVSS

SEQ ID NO: 59 - protein, 114 aa, Artificial Sequence
  source: /note="Description of Artificial Sequence: Synthetic polypeptide"
DVQLQESGPDLVKPSQSLSLTCIVAGFSLTDSYSWHWIRQFPGNKLEWMGYIHYSGRTNYNPSLKTQFSITRNTSKNQFFLQLISVPTEDTATYYCARYDFAYWGRGTSVTVSS

SEQ ID NO: 60 - protein, 117 aa, Artificial Sequence
  source: /note="Description of Artificial Sequence: Synthetic polypeptide"
DVQLQESGPGLVKPSQSLSLTCTVTGYSITSDYAWNWIRQFPGNKLEWMGYISYSGSIRYNPSLKSRISITRDTSKNQFFLQLNSVTTEDTATYYCAITTGGYFDYWGQGTTLTVSS

SEQ ID NO: 61 - protein, 120 aa, Artificial Sequence
  source: /note="Description of Artificial Sequence: Synthetic polypeptide"
QVQLKQSGAELVRPGSSVGISCKASGYAFTNFWMNWVRQRPGQGLEWIGQLYPGDDDTHYNGKFKGKVTLTADRSSGTAYMQLSRLTSEDSAVYFCAVTEVKRRRSFAYWGQGTLVTVSA

SEQ ID NO: 62 - protein, 112 aa, Artificial Sequence
  source: /note="Description of Artificial Sequence: Synthetic polypeptide"
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTLVPPTFGGGTKLEIK

SEQ ID NO: 63 - protein, 107 aa, Artificial Sequence
  source: /note="Description of Artificial Sequence: Synthetic polypeptide"
DIVMTQSQKFMSTTAGDRVSITCKASQNVGSAVVWYQQKPGRSPKLLIYSSSIRYTGVPDRFTGSGSGTDFTLTINSVQSEDLADYFCQQYNSFPLTFGAGTKLEIK

SEQ ID NO: 64 - protein, 112 aa, Artificial Sequence
  source: /note="Description of Artificial Sequence: Synthetic polypeptide"
DVVMTQTPLSLPVSLGDQASISCRSSQSLVHSNGNTYLHWYLQKPGQSPKLLIYKVSNRFSGVPDRFSGSGSGTDFKLKISRVEAEDLGVYFCSQSTHVPPTFGGGTKLEIK

SEQ ID NO: 65 - protein, 112 aa, Artificial Sequence
  source: /note="Description of Artificial Sequence: Synthetic polypeptide"
DVVMTQTPLTLSVTIGQPASISCKSSQSLLHSNGKTYLNWLLQRPGQSPKRLIYLVSKLDSGVPDRFTGSGSGTDFTLKISRVEAEDLGVYCCVQGTHVPYTFGGGTKLEIK

SEQ ID NO: 66 - protein, 112 aa, Artificial Sequence
  source: /note="Description of Artificial Sequence: Synthetic polypeptide"
DVVMTQTPLTLSVTIGQPASISCKSSQSLLHSNGKTYLNWLLQRPGQSPKRLIYLVSKLDSGVPDRFTGSGSGTDFTLKISRVEAEDLGVYYCVQGTHVPYTFGGGTKLEIK

SEQ ID NO: 67 - protein, 112 aa, Artificial Sequence
  source: /note="Description of Artificial Sequence: Synthetic polypeptide"
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCLQATHFPWTFGGGTKLEIK

SEQ ID NO: 68 - protein, 107 aa, Artificial Sequence
  source: /note="Description of Artificial Sequence: Synthetic polypeptide"
DIVMTQSQNFMSTSVGDRVSVTCKASQYVGTYVAWYQQKPGQSPKALIYSASYRHTGVPDRFTGSGSGTDFTLTISNVQSEDLADYFCQQYSSSPYTFGGGTKLEIK

SEQ ID NO: 69 - protein, 113 aa, Artificial Sequence
  source: /note="Description of Artificial Sequence: Synthetic polypeptide"
DIVMTQSPSSLSVSAGEKVTMSCKSSQSLLKSGNQKNYLAWHQQKPGQPPKLLIYGASTRESGVPDRFTGSGSGTDFTLTISSVQAEDLAVYYCQNDHSHPYTFGGGTKLEIK

SEQ ID NO: 70 - protein, 112 aa, Artificial Sequence
  source: /note="Description of Artificial Sequence: Synthetic polypeptide"
DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLYTFGGGTKLEIK

SEQ ID NO: 71 - protein, 107 aa, Artificial Sequence
  source: /note="Description of Artificial Sequence: Synthetic polypeptide"
DIVMTQSQKFMSTTVGDRVSITCKASQNVGAAVVWYQQKPGQSPKLLIYSASYRYSGVPDRFTGSGSGTDFTLTISNMQSEDLADYFCQQYNSFPLTFGGGTKLEIK

SEQ ID NO: 72 - protein, 112 aa, Artificial Sequence
  source: /note="Description of Artificial Sequence: Synthetic polypeptide"
DVVMTQTPLSLTVSLGDQASISCRSSQSLVHSNGNTYLHWYLQKPGQSPKFLIYKVSNRFSGVPDRFSGSGSGTDFRLKISRVEAEDLGVYFCSQSTLVPLTFGAGTKLEIK

SEQ ID NO: 73 - protein, 112 aa, Artificial Sequence
  source: /note="Description of Artificial Sequence: Synthetic polypeptide"
DIVMSQSPSSLAVSVGEKVTMSCKSSQSLFNSRTRKNYLAWYQQKPGQSPKLLIYWASTRESGVPDRFTGSGSGTDFTLTINSVQAEDLALYYCNQSYDLLTFGAGTKLEIK

SEQ ID NO: 74 - protein, 107 aa, Artificial Sequence
  source: /note="Description of Artificial Sequence: Synthetic polypeptide"
DIVMTQSQKFMSSAVGDRVTITCKASQNVGAAVAWYQQKPGQSPKLLLYSASIRYTGVPDRFTGSGSGTDFTLTISNIQSEDLAHFFCQQYNSFPLTFGGGTKLEIK

SEQ ID NO: 75 - protein, 107 aa, Artificial Sequence
  source: /note="Description of Artificial Sequence: Synthetic polypeptide"
DIVMTQSQKFMSTTVGDRVSITCKASQNVGAAVVWYQQKPGQSPKLLIYSASYRYTGVPDRFTGSGSGTDFTLTISNMQSEDVADYFCQQYNSFPLTFGGGTKLEIK

SEQ ID NO: 76 - protein, 112 aa, Artificial Sequence
  source: /note="Description of Artificial Sequence: Synthetic polypeptide"
DIVMSQSPSSLAVSAGEKVTMSCKSSQSLLSSRTRKNYLAWYQQKPGQSPKLLIYWASTRESGVPDRFTGSGSGTDFTLTISSVQAEDLALYFCNQSYDLLTFGAGTKLEIK

SEQ ID NO: 77 - protein, 107 aa, Artificial Sequence
  source: /note="Description of Artificial Sequence: Synthetic polypeptide"
DIVMTQSPATLSVTPGDRVSLSCRASQSISDYLHWYQQKSHESPRLLIKYASQSISGIPSRFSGSGSGSDFTLSINSVEPEDVGVYYCQNGHSFPPTFGAGTKLEIK

SEQ ID NO: 78 - protein, 107 aa, Artificial Sequence
  source: /note="Description of Artificial Sequence: Synthetic polypeptide"
DIVMTQSQKFMSTTLGDRVSIPCKASQSVGAAVAWYQQKPGQSPKLLIYSASIRYAGVPDRFTGSGSGTDFTLTVSNMRSEDLADYFCQQYNSFPLTFGGGTKLEIK

SEQ ID NO: 79 - protein, 107 aa, Artificial Sequence
  source: /note="Description of Artificial Sequence: Synthetic polypeptide"
DIQMTQSSSYLSVSLGGRVTITCKASDHINNWLAWYQQKPGNAPRLLISGATSLETGVPSRFSGSGSGKDYTLSITSLQTEDVATYYCQQYWSTPYTFGGGTKLEIK

SEQ ID NO: 80 - protein, 112 aa, Artificial Sequence
  source: /note="Description of Artificial Sequence: Synthetic polypeptide"
DVVMTQTPLTLSVTIGQPVSISCKSSQSLLESDGKTYLNWLLQRPGESPKLLIYLVSKLDSGVPDRFTGSGSGTDFTLKISRVEAEDLGVFYCLQATHFPHTFGGGTKLEIK

SEQ ID NO: 81 - protein, 107 aa, Artificial Sequence
  source: /note="Description of Artificial Sequence: Synthetic polypeptide"
DIQMTQSPSSLSASLGERVSLTCRASQEIKTYLSWLQQKPDGTIKRLIYAATTLESVVPKRFSGSWSGSEYSLTISSLESEDFADYYCLQYASYPWTFGGGTKLEIK

SEQ ID NO: 82 - protein, 107 aa, Artificial Sequence
  source: /note="Description of Artificial Sequence: Synthetic polypeptide"
DVQITQSPSYLAASPGETITINCRASKSISKYLAWYQEKPGKTNKLLIYSGSTLQSGIPSRFSGSGSGTDFTLTISSLEPEDFAMYYCQQHDEYPWTFGGGTKLEIK

SEQ ID NO: 83 - protein, 107 aa, Artificial Sequence
  source: /note="Description of Artificial Sequence: Synthetic polypeptide"
DIVMTQSQKFMSTSVGDRVSVTCKASQNVGENVSWYQQKPGQFPKALIYSASYRYSGVPDRFTGSGSGTDFSLTISNVQSEDLAEYFCQQYNSSPWTFGGGTKLEIK

SEQ ID NO: 84 - protein, 112 aa, Artificial Sequence
  source: /note="Description of Artificial Sequence: Synthetic polypeptide"
DVVMTQSPLTLSVTIGQPASISCRSSRSLLDSDGKTKLHWLLQRPGQSPKSLIYLVSKLDSGVPNRFTGGGSGTDFTLKINRVEAEDLGVYYCWQGTHFPWTFGVGTKLEIK

SEQ ID NO: 85 - protein, 112 aa, Artificial Sequence
  source: /note="Description of Artificial Sequence: Synthetic polypeptide"
DVVMTQTPLSLPVSLGGQASISCRSSQSLVHSNGNTYLHWYLQKPGQSPKFLIYKVSNRISGVPDRFSGSGSGTDFTLKISRVEAEDLGVYFCSQSTLVPLTFGAGTKLELR

SEQ ID NO: 86 - protein, 112 aa, Artificial Sequence
  source: /note="Description of Artificial Sequence: Synthetic polypeptide"
DVVMTQTPLSLPVSLGDQASISCRSSQSLVHSNGNTYLQWYLQKPGQSPKLLIYKVSNRFSGVPDRFSGSGSGTEFTLKIRRVEAEDLGVFLCSQSTLVPLTFGAGTKLELK

SEQ ID NO: 87 - protein, 112 aa, Artificial Sequence
  source: /note="Description of Artificial Sequence: Synthetic polypeptide"
DVVMTQTPLSLPVSLGDQVSISCRSSQSLVHSNGNTYLQWYLQKPGQSPKLLIYKVSNRFSGVPDRFSGSGSGTDFTLKISRVEAEDLGVYFCSQSTLVPLTFGAGTKLELR

SEQ ID NO: 88 - protein, 106 aa, Artificial Sequence
  source: /note="Description of Artificial Sequence: Synthetic polypeptide"
ENVLTQSPAIMSASPGEKVTITCSASSSVSYMHWFQQKPGTSPKLWIYSTSNLASGVPTRFSGSGSGTSYSLTISRMEAEDAATYYCQQRSSYPPTFGGGAKLEIK

SEQ ID NO: 89 - protein, 111 aa, Artificial Sequence
  source: /note="Description of Artificial Sequence: Synthetic polypeptide"
DIVMTQSPSSLAVSVGEKVTMSCKSSQSLFSSRTRKNYLAWYQQKPGQSPKLLIYWASTRESGVPYRFTGSGSGTDFTLTISSVQTEDLAVYYCKQSYNLLTFGAGTKLEL

SEQ ID NO: 90 - protein, 112 aa, Artificial Sequence
  source: /note="Description of Artificial Sequence: Synthetic polypeptide"
DVVMTQTPLSLPVSLGDQASISCRSSQSLVHSNGNTYLHWYLQKPGQSPKLLIYRVSNRFSGVPDRFSGSGSGTDFTLKISRVEAEDLGVYFCSQSTHVPPTFGGGTKLEIK

SEQ ID NO: 91 - protein, 112 aa, Artificial Sequence
  source: /note="Description of Artificial Sequence: Synthetic polypeptide"
DVVMTQTPLSLPVSLGDQASVSCRSSQSLVHSTGNTFLHWYLQKPGQSPKLLIYKVSNRFSGVPDRFSGSGSGTDFTLKISRVEAEDLGVYFCSQSTLVPLTFGAGTKLELK

SEQ ID NO: 92 - protein, 112 aa, Artificial Sequence
  source: /note="Description of Artificial Sequence: Synthetic polypeptide"
DVVMTQTPLSLPVSLGDQASISCRSSQSLVHSNGNTYLHWYLQKPGQSPKLLIYKVSNRFSGLPDRFSGSGSGTDFTLKISRVEAEDLGVYFCSQSTLVPPTFGGGTKLEIK

SEQ ID NO: 93 - protein, 112 aa, Artificial Sequence
  source: /note="Description of Artificial Sequence: Synthetic polypeptide"
DVVMTQTPLSLPVSLGDQASISCRSSQSLVHNNGVTYLHWYLQKPGQSPKLLIYKVSNRFSGVPDRFSGSGSGTDFTLKISRVEAEDLGVYFCSQSTHVPITFGAGTKLELK

SEQ ID NO: 94 - protein, 112 aa, Artificial Sequence
  source: /note="Description of Artificial Sequence: Synthetic polypeptide"
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPFTFGSGTKLEIK

SEQ ID NO: 95 - protein, 112 aa, Artificial Sequence
  source: /note="Description of Artificial Sequence: Synthetic polypeptide"
DVVMTQTPLSLPVSLGDQASISCRSSQSLVHSNGNTYLHWYLQKSGQSPKLLIYKVSNRFSGVPDRFSGSGSGTDFTLKISRVEAEDLGVYFCSQSTHVPYTFGGGTKLEIK

SEQ ID NO: 96 - protein, 111 aa, Artificial Sequence
  source: /note="Description of Artificial Sequence: Synthetic polypeptide"
DIVLTQSPASLAVSLGQRATISCRASKSVSTSGYSYLHWYQQKPGQPPKLLIYLASNLESGVPARFSGSGSGTDFTLNIHPVEEEDAATYYCQHNRELPPTFGGGTKLEIK

SEQ ID NO: 97 - protein, 112 aa, Artificial Sequence
  source: /note="Description of Artificial Sequence: Synthetic polypeptide"
DVVMTQSPLTLSVTIGQPASISCKSSQSLLYSNGKTYLNWLLQRPGQSPKRLIYLVSKLDSGVPDRFTGSGSGTDFTLKISRVEAEDLGVYYCVQGTHFPHTFGGGTKLEIK

SEQ ID NO: 98 - protein, 112 aa, Artificial Sequence
  source: /note="Description of Artificial Sequence: Synthetic polypeptide"
DVVMTQTPLSLPVSLGDHASISCRSSQSLIHSNGNNYLHWYLQKPGQSPKLLIYTVSNRFSGVPDRFSGSGSGTDFTLKISRVEAEDLGVYFCSQSTLVPLTFGSGTKLEIK

SEQ ID NO: 99 - protein, 113 aa, Artificial Sequence
  source: /note="Description of Artificial Sequence: Synthetic polypeptide"
DIVMTQSPSSLAMSVGQKVTMSCKSSQSLLNSSSQKNYLAWYQQKPGQSPKLLIYFASTRESGVPDRFIGSGSGTDFTLTISNVQAEDLADYFCQQHYSTPPTFGGGTKLEIK

SEQ ID NO: 100 - protein, 112 aa, Artificial Sequence
  source: /note="Description of Artificial Sequence: Synthetic polypeptide"
DVVMTQTPLSLPVSLGDHASISCRSSQSLIHSNGNNYLHWYLQKPGQSPQLLIYKVSNRFSGVPDRFSGSGSGTDFTLKISRVEAEDLGVYFCSQSTLVPLTFGSGTKLELR

SEQ ID NO: 101 - protein, 112 aa, Artificial Sequence
  source: /note="Description of Artificial Sequence: Synthetic polypeptide"
DVVMTQTPLSLPVSLGDHASISCRSSQSLVHSNGNIYLHWYLQRPGQSPKLLIHKVSNRFSGVPDRFSGSGSGTDFTLKISRVEAEDVGIYFCSQSTLVPLTFGSGTKLELK

SEQ ID NO: 102 - protein, 112 aa, Artificial Sequence
  source: /note="Description of Artificial Sequence: Synthetic polypeptide"
DVVMTQTPLSLPVSLGDHASISCRSSQSLVHSNGNTYLHWYLQRPGQSPKLLIHKVSNRFSGVPDRFSGSGSGTDFTLKISRVEAEDVGIYFCSQSTLVPLTFGSGTKLELK

SEQ ID NO: 103 - protein, 112 aa, Artificial Sequence
  source: /note="Description of Artificial Sequence: Synthetic polypeptide"
DVVMTQTPLSLPVSLGDHASISCRSSQSLIHSNGNNYLHWYLQKPGQSPKLLIYKVSNRFSGVPDRFSGSGSGTDFTLKISRVEAEDLGVYFCSQSTLVPLTFGSGTKLELK

SEQ ID NO: 104 - protein, 112 aa, Artificial Sequence
  source: /note="Description of Artificial Sequence: Synthetic polypeptide"
DVVMTQSPLSLPVSLGDHASISCRSSQSLIHSNGNNYLHWYLQKPGQSPKLLIYTVSNRFSGVPDRFSGSGSGTDFTLKISRVEAEDLGVYFCSQSTLVPLTFGSGTKLEVK

SEQ ID NO: 105 - protein, 112 aa, Artificial Sequence
  source: /note="Description of Artificial Sequence: Synthetic polypeptide"
DVVMTQTPLSLPVSLGDHASISCRSSQSLIHSNGNNYLHWYLQKPGQSPKLLIYTVSNRFSGVPDRFSGSGSGTDFTLKISRVEAEDLGVYFCSQSTLVPLTFGSGTKLEVK

SEQ ID NO: 106 - protein, 112 aa, Artificial Sequence
  source: /note="Description of Artificial Sequence: Synthetic polypeptide"
DIVMTQTPLSLPVSLGDQASISCRSSQSLVHSSGNTYLHWYLQKPGQSPKLLIYKVSNRFSGVPDRFSGSGSGTDFTLRISRVAAEDLGVYFCSQSTLVPVTFGAGTELELK

SEQ ID NO: 107 - protein, 112 aa, Artificial Sequence
  source: /note="Description of Artificial Sequence: Synthetic polypeptide"
DVVMTQTPLSLPVSLGNQASISCRSSQRLVHSNGNTYLHWYLQKPGQSPKLLIYKVFNRFSGVPDRFSGSGSGTDFTLKISRVEAEDLGIYFCAQSTLVPPTFGGGTKLEIK

SEQ ID NO: 108 - protein, 112 aa, Artificial Sequence
  source: /note="Description of Artificial Sequence: Synthetic polypeptide"
DVVMTQTPLSLPVSLGDQASISCRSSQSLVHSSENTYLHWYLQKPGQSPKLLIYKVSNRFSGVPDRFSGSGSGTDFTLKISRVEAEDLGVYFCSQSTLVPVTFGAGTKLELK

SEQ ID NO: 109 - protein, 112 aa, Artificial Sequence
  source: /note="Description of Artificial Sequence: Synthetic polypeptide"
DVVMTQTPLSLPVSLGNQASISCRSSQSLVHSNGNTYLHWYLQKPGQSPRLLIYKVFNRFSGVPDRFSGSGSGTDFTLKISRVEAEDLGVYFCAQSTLVPPTFGGGTKLEIK

SEQ ID NO: 110 - protein, 112 aa, Artificial Sequence
  source: /note="Description of Artificial Sequence: Synthetic polypeptide"
DVVMTQTPLSLPVSLGDQASISCRSSQSLVHSSENTYLHWYVQKPGQSPKLLIYKVSNRFSGVPDRFSGSGSGTDFTLKISRVEAEDLGVYFCSQSTLVPVTFGAGTKLELK

SEQ ID NO: 111 - protein, 112 aa, Artificial Sequence
  source: /note="Description of Artificial Sequence: Synthetic polypeptide"
DVVMTQTPLSLPVSLGNQASISCRSSQSLVHSNGNTYLHWYLQKPGQSPRLLIYKVFNRFPGVPDRFSGSGSGTDFTLKISRVEAEDLGVYFCAQSTLVPPTFGGGTKLEIK

SEQ ID NO: 112 - protein, 111 aa, Artificial Sequence
  source: /note="Description of Artificial Sequence: Synthetic polypeptide"
DVVMTQTPLSLPVSLGDQASISCRSSQSLVHSSGNTYLHWYLQKPGQSPKLLIYKVSNRFSGVPDRFSGSGSGTHFTLKLSRVEAEDLGIYFCSQSTLIPLTFGAGTKLEL

SEQ ID NO: 113 - protein, 107 aa, Artificial Sequence
  source: /note="Description of Artificial Sequence: Synthetic polypeptide"
DIQMTQSPSSLSASLGEKVSLTCRASQEISGYLSWLQQKPDGSIKRLIYAASTLDSGVPKRFSGSRSGSVYSLTISSLESEDFADYYCLHYANYPPTFGGGTKLEIR

SEQ ID NO: 114 - protein, 107 aa, Artificial Sequence
  source: /note="Description of Artificial Sequence: Synthetic polypeptide"
DVQMTQSPSSLSASLGDTITITCHASQNIYVWLNWFQQKPGNIPKLLISKASDLHTGVPSRFSGSGSGTGFTLTISSLQPEDIATYYCQQGLSYPLTFGGGTNLEIK

SEQ ID NO: 115 - protein, 112 aa, Artificial Sequence
  source: /note="Description of Artificial Sequence: Synthetic polypeptide"
DVVMTQTPLSPPVSLGYQASISCRSSQSLVHSNGNTYLNWYLQKPGQSPKLLIYKVSNRLSGVPDRFSGSGSGTDFTLKISRVETEDLGVYFCSQSTHVPYTFGGGTKLEIK

SEQ ID NO: 116 - protein, 112 aa, Artificial Sequence
  source: /note="Description of Artificial Sequence: Synthetic polypeptide"
DVVMTQTPLSLPVSLGDRASISCRSGQSLVHSNGNTYLHWYLQRPGRSPNLLIYKVSNRFSGVPDRFSGSGSGTDFTLKISRVEAEDLGVYFCSQSTHVPWTFGGGTKLEIK

SEQ ID NO: 117 - protein, 112 aa, Artificial Sequence
  source: /note="Description of Artificial Sequence: Synthetic polypeptide"
DVVMTQTPLSLPVSLGDQASISCRFSQSIVYSNGNTYLQWYLQKPGQSPKLLIYKVSNRFSGVPDRFSGSGSGTDFTLKISRVEAEDLGVYYCFQGSHVPPTFGGGTKLEIK

SEQ ID NO: 118 - protein, 112 aa, Artificial Sequence
  source: /note="Description of Artificial Sequence: Synthetic polypeptide"
DVVMTQTPLTLSVTIGQPTSISCKSSQSLLYSNGKTYLSWLLQRPGQSPKRLIYLVSKLDSGVPDRFTGSGSGTDFTLKINRVEAEDLGLYYCVQNTHLPYTFGGGTKLEIR

SEQ ID NO: 119 - protein, 107 aa, Artificial Sequence
  source: /note="Description of Artificial Sequence: Synthetic polypeptide"
DIQMTQSTSSLSASLGDRVTISCRASQDISNYLNWYQQTPDGTVKLLIYQISRLHSGVPSRFSGSGSGTDYSLTISNLEEEDIANYFCQQGNSLPPTFGGGTKVEIK

SEQ ID NO: 120 - protein, 107 aa, Artificial Sequence
  source: /note="Description of Artificial Sequence: Synthetic polypeptide"
DIQMNQSPSSLSASLGDTITITCHASQNIDVWLSWYQQKPGNIPKLLIYKASNLHTGVPSRFSGRDSGTAFTLTISSLQPEDIATYYCQQGHSYPLTFGSGTKLELK

SEQ ID NO: 121 - protein, 8 aa, Artificial Sequence
  source: /note="Description of Artificial Sequence: Synthetic peptide"
GYSFSSSW

SEQ ID NO: 122 - protein, 8 aa, Artificial Sequence
  source: /note="Description of Artificial Sequence: Synthetic peptide"
GYSFSSSW

SEQ ID NO: 123 - protein, 8 aa, Artificial Sequence
  source: /note="Description of Artificial Sequence: Synthetic peptide"
GYTFIDHA

SEQ ID NO: 124 - protein, 8 aa, Artificial Sequence
  source: /note="Description of Artificial Sequence: Synthetic peptide"
GFSLTSYA

SEQ ID NO: 125 - protein, 8 aa, Artificial Sequence
  source: /note="Description of Artificial Sequence: Synthetic peptide"
GYAFSRYW

SEQ ID NO: 126 - protein, 8 aa, Artificial Sequence
  source: /note="Description of Artificial Sequence: Synthetic peptide"
GYSFTTFG

SEQ ID NO: 127 - protein, 8 aa, Artificial Sequence
  source: /note="Description of Artificial Sequence: Synthetic peptide"
GYAFSSYW

SEQ ID NO: 128 - protein, 8 aa, Artificial Sequence
  source: /note="Description of Artificial Sequence: Synthetic peptide"
GYTFTSYW

SEQ ID NO: 129 - protein, 8 aa, Artificial Sequence
  source: /note="Description of Artificial Sequence: Synthetic peptide"
GYTFTSYW

SEQ ID NO: 130 - protein, 8 aa, Artificial Sequence
  source: /note="Description of Artificial Sequence: Synthetic peptide"
GYTFTSYW

SEQ ID NO: 131 - protein, 8 aa, Artificial Sequence
  source: /note="Description of Artificial Sequence: Synthetic peptide"
GHTFTDHA

SEQ ID NO: 132 - protein, 8 aa, Artificial Sequence
  source: /note="Description of Artificial Sequence: Synthetic peptide"
GYTFTNYW

SEQ ID NO: 133 - protein, 8 aa, Artificial Sequence
  source: /note="Description of Artificial Sequence: Synthetic peptide"
GFSLTSYG

SEQ ID NO: 134 - protein, 8 aa, Artificial Sequence
  source: /note="Description of Artificial Sequence: Synthetic peptide"
GYTFTDHS

SEQ ID NO: 135 - protein, 8 aa, Artificial Sequence
  source: /note="Description of Artificial Sequence: Synthetic peptide"
GYTFTDHA

SEQ ID NO: 136 - protein, 8 aa, Artificial Sequence
  source: /note="Description of Artificial Sequence: Synthetic peptide"
GFTFSDAW

SEQ ID NO: 137 - protein, 8 aa, Artificial Sequence
  source: /note="Description of Artificial Sequence: Synthetic peptide"
GFSLISYG

SEQ ID NO: 138 - protein, 8 aa, Artificial Sequence
  source: /note="Description of Artificial Sequence: Synthetic peptide"
GYTFTSYW

SEQ ID NO: 139 - protein, 8 aa, Artificial Sequence
  source: /note="Description of Artificial Sequence: Synthetic peptide"
GYTFTDYN

SEQ ID NO: 140 - protein, 8 aa, Artificial Sequence
  source: /note="Description of Artificial Sequence: Synthetic peptide"
GYTFTKYV

SEQ ID NO: 141 - protein, 8 aa, Artificial Sequence
  source: /note="Description of Artificial Sequence: Synthetic peptide"
GYSFTSYW

SEQ ID NO: 142 - protein, 8 aa, Artificial Sequence
  source: /note="Description of Artificial Sequence: Synthetic peptide"
GYTFTEYT

SEQ ID NO: 143 - protein, 8 aa, Artificial Sequence
  source: /note="Description of Artificial Sequence: Synthetic peptide"
GFTFSNYG

SEQ ID NO: 144 - protein, 8 aa, Artificial Sequence
  source: /note="Description of Artificial Sequence: Synthetic peptide"
GYTFTTFG

SEQ ID NO: 145 - protein, 8 aa, Artificial Sequence
  source: /note="Description of Artificial Sequence: Synthetic peptide"
GYTFISYW

SEQ ID NO: 146 - protein, 8 aa, Artificial Sequence
  source: /note="Description of Artificial Sequence: Synthetic peptide"
GYTFSSYW

SEQ ID NO: 147 - protein, 8 aa, Artificial Sequence
  source: /note="Description of Artificial Sequence: Synthetic peptide"
GYTFTSYW

SEQ ID NO: 148 - protein, 8 aa, Artificial Sequence
  source: /note="Description of Artificial Sequence: Synthetic peptide"
GYTFTAYG

SEQ ID NO: 149 - protein, 8 aa, Artificial Sequence
  source: /note="Description of Artificial Sequence: Synthetic peptide"
GFSLINSA

SEQ ID NO: 150 - protein, 8 aa, Artificial Sequence
  source: /note="Description of Artificial Sequence: Synthetic peptide"
GFSLTSYG

SEQ ID NO: 151 - protein, 8 aa, Artificial Sequence
  source: /note="Description of Artificial Sequence: Synthetic peptide"
GYIFTSYW

SEQ ID NO: 152 - protein, 8 aa, Artificial Sequence
  source: /note="Description of Artificial Sequence: Synthetic peptide"
GFSLTSYG

SEQ ID NO: 153 - protein, 8 aa, Artificial Sequence
  source: /note="Description of Artificial Sequence: Synthetic peptide"
GYSFTRYW

SEQ ID NO: 154 - protein, 8 aa, Artificial Sequence
  source: /note="Description of Artificial Sequence: Synthetic peptide"
GFSLTTYG

SEQ ID NO: 155 - protein, 9 aa, Artificial Sequence
  source: /note="Description of Artificial Sequence: Synthetic peptide"
GYSITSGYS

SEQ ID NO: 156 - protein, 9 aa, Artificial Sequence
  source: /note="Description of Artificial Sequence: Synthetic peptide"
GYSITSDYA

SEQ ID NO: 157 - protein, 8 aa, Artificial Sequence
  source: /note="Description of Artificial Sequence: Synthetic peptide"
GFTFSSYT

SEQ ID NO: 158 - protein, 8 aa, Artificial Sequence
  source: /note="Description of Artificial Sequence: Synthetic peptide"
GYTFTNYW

SEQ ID NO: 159 - protein, 8 aa, Artificial Sequence
  source: /note="Description of Artificial Sequence: Synthetic peptide"
GYTFTSYT

SEQ ID NO: 160 - protein, 8 aa, Artificial Sequence
  source: /note="Description of Artificial Sequence: Synthetic peptide"
GYTFTSYW

SEQ ID NO: 161 - protein, 8 aa, Artificial Sequence
  source: /note="Description of Artificial Sequence: Synthetic peptide"
GYTFTNYW

SEQ ID NO: 162 - protein, 8 aa, Artificial Sequence
  source: /note="Description of Artificial Sequence: Synthetic peptide"
GYTFTNHW

SEQ ID NO: 163 - protein, 8 aa, Artificial Sequence
  source: /note="Description of Artificial Sequence: Synthetic peptide"
GYTFTNHW

SEQ ID NO: 164 - protein, 8 aa, Artificial Sequence
  source: /note="Description of Artificial Sequence: Synthetic peptide"
GYSFTNYW

SEQ ID NO: 165 - protein, 8 aa, Artificial Sequence
  source: /note="Description of Artificial Sequence: Synthetic peptide"
GYTFTDYY

SEQ ID NO: 166 - protein, 8 aa, Artificial Sequence
  source: /note="Description of Artificial Sequence: Synthetic peptide"
GFSLTNYG

SEQ ID NO: 167 - protein, 8 aa, Artificial Sequence
  source: /note="Description of Artificial Sequence: Synthetic peptide"
GYTFTDYY

SEQ ID NO: 168 - protein, 8 aa, Artificial Sequence
  source: /note="Description of Artificial Sequence: Synthetic peptide"
GFSLTNCG

SEQ ID NO: 169 - protein, 8 aa, Artificial Sequence
  source: /note="Description of Artificial Sequence: Synthetic peptide"
GYTFTDYY

SEQ ID NO: 170 - protein, 8 aa, Artificial Sequence
  source: /note="Description of Artificial Sequence: Synthetic peptide"
GFSLTNCG

SEQ ID NO: 171 - protein, 8 aa, Artificial Sequence
  source: /note="Description of Artificial Sequence: Synthetic peptide"
GYTFSDYY

SEQ ID NO: 172 - protein, 9 aa, Artificial Sequence
  source: /note="Description of Artificial Sequence: Synthetic peptide"
GYSITSDSA

SEQ ID NO: 173 - protein, 8 aa, Artificial Sequence
  source: /note="Description of Artificial Sequence: Synthetic peptide"
GFNIKDSY

SEQ ID NO: 174 - protein, 9 aa, Artificial Sequence
  source: /note="Description of Artificial Sequence: Synthetic peptide"
GYSITSDSA

SEQ ID NO: 175 - protein, 9 aa, Artificial Sequence
  source: /note="Description of Artificial Sequence: Synthetic peptide"
GYSITSDSA

SEQ ID NO: 176 - protein, 8 aa, Artificial Sequence
  source: /note="Description of Artificial Sequence: Synthetic peptide"
GFTFNAYA

SEQ ID NO: 177 - protein, 9 aa, Artificial Sequence
  source: /note="Description of Artificial Sequence: Synthetic peptide"
GYSITSGYS

SEQ ID NO: 178 - protein, 9 aa, Artificial Sequence
  source: /note="Description of Artificial Sequence: Synthetic peptide"
GYSITSDYA

SEQ ID NO: 179 - protein, 9 aa, Artificial Sequence
  source: /note="Description of Artificial Sequence: Synthetic peptide"
GFSLTDSYS

SEQ ID NO: 180 - protein, 9 aa, Artificial Sequence
  source: /note="Description of Artificial Sequence: Synthetic peptide"
GYSITSDYA

SEQ ID NO: 181 - protein, 8 aa, Artificial Sequence
  source: /note="Description of Artificial Sequence: Synthetic peptide"
GYAFTNFW

SEQ ID NO: 182 - protein, 11 aa, Artificial Sequence
  source: /note="Description of Artificial Sequence: Synthetic peptide"
QSLVHSNGNTY

SEQ ID NO: 183 - protein, 6 aa, Artificial Sequence
  source: /note="Description of Artificial Sequence: Synthetic peptide"
QNVGSA

SEQ ID NO: 184 - protein, 11 aa, Artificial Sequence
  source: /note="Description of Artificial Sequence: Synthetic peptide"
QSLVHSNGNTY

SEQ ID NO: 185 - protein, 11 aa, Artificial Sequence
  source: /note="Description of Artificial Sequence: Synthetic peptide"
QSLLHSNGKTY

SEQ ID NO: 186 - protein, 11 aa, Artificial Sequence
  source: /note="Description of Artificial Sequence: Synthetic peptide"
QSLLHSNGKTY

SEQ ID NO: 187 - protein, 11 aa, Artificial Sequence
  source: /note="Description of Artificial Sequence: Synthetic peptide"
QSLLDSDGKTY

SEQ ID NO: 188 - protein, 6 aa, Artificial Sequence
  source: /note="Description of Artificial Sequence: Synthetic peptide"
QYVGTY

SEQ ID NO: 189 - protein, 12 aa, Artificial Sequence
  source: /note="Description of Artificial Sequence: Synthetic peptide"
QSLLKSGNQKNY

SEQ ID NO: 190 - protein, 12 aa, Artificial Sequence
  source: /note="Description of Artificial Sequence: Synthetic peptide"
QSLLNSRTRKNY

SEQ ID NO: 191 - protein, 6 aa, Artificial Sequence
  source: /note="Description of Artificial Sequence: Synthetic peptide"
QNVGAA

SEQ ID NO: 192 - protein, 11 aa, Artificial Sequence
  source: /note="Description of Artificial Sequence: Synthetic peptide"
QSLVHSNGNTY

SEQ ID NO: 193 - protein, 12 aa, Artificial Sequence
  source: /note="Description of Artificial Sequence: Synthetic peptide"
QSLFNSRTRKNY

SEQ ID NO: 194 - protein, 6 aa, Artificial Sequence
  source: /note="Description of Artificial Sequence: Synthetic peptide"
QNVGAA

SEQ ID NO: 195 - protein, 6 aa, Artificial Sequence
  source: /note="Description of Artificial Sequence: Synthetic peptide"
QNVGAA

SEQ ID NO: 196 - protein, 12 aa, Artificial Sequence
  source: /note="Description of Artificial Sequence: Synthetic peptide"
QSLLSSRTRKNY

SEQ ID NO: 197 - protein, 6 aa, Artificial Sequence
  source: /note="Description of Artificial Sequence: Synthetic peptide"
QSISDY

SEQ ID NO: 198 - protein, 6 aa, Artificial Sequence
  source: /note="Description of Artificial Sequence: Synthetic peptide"
QSVGAA

SEQ ID NO: 199 - protein, 6 aa, Artificial Sequence
  source: /note="Description of Artificial Sequence: Synthetic peptide"
DHINNW

SEQ ID NO: 200 - protein, 11 aa, Artificial Sequence
  source: /note="Description of Artificial Sequence: Synthetic peptide"
QSLLESDGKTY

SEQ ID NO: 201 - protein, 6 aa, Artificial Sequence
  source: /note="Description of Artificial Sequence: Synthetic peptide"
QEIKTY

SEQ ID NO: 202 - protein, 6 aa, Artificial Sequence
  source: /note="Description of Artificial Sequence: Synthetic peptide"
KSISKY

SEQ ID NO: 203 - protein, 6 aa, Artificial Sequence
  source: /note="Description of Artificial Sequence: Synthetic peptide"
QNVGEN

SEQ ID NO: 204 - protein, 11 aa, Artificial Sequence
  source: /note="Description of Artificial Sequence: Synthetic peptide"
RSLLDSDGKTK

SEQ ID NO: 205 - protein, 11 aa, Artificial Sequence
  source: /note="Description of Artificial Sequence: Synthetic peptide"
QSLVHSNGNTY

SEQ ID NO: 206 - protein, 11 aa, Artificial Sequence
  source: /note="Description of Artificial Sequence: Synthetic peptide"
QSLVHSNGNTY

SEQ ID NO: 207 - protein, 11 aa, Artificial Sequence
  source: /note="Description of Artificial Sequence: Synthetic peptide"
QSLVHSNGNTY

SEQ ID NO: 208 - protein, 5 aa, Artificial Sequence
  source: /note="Description of Artificial Sequence: Synthetic peptide"
SSVSY

SEQ ID NO: 209 - protein, 12 aa, Artificial Sequence
  source: /note="Description of Artificial Sequence: Synthetic peptide"
QSLFSSRTRKNY

SEQ ID NO: 210 - protein, 11 aa, Artificial Sequence
  source: /note="Description of Artificial Sequence: Synthetic peptide"
QSLVHSNGNTY

SEQ ID NO: 211 - protein, 11 aa, Artificial Sequence
  source: /note="Description of Artificial Sequence: Synthetic peptide"
QSLVHSTGNTF

SEQ ID NO: 212 - protein, 11 aa, Artificial Sequence
  source: /note="Description of Artificial Sequence: Synthetic peptide"
QSLVHSNGNTY

SEQ ID NO: 213 - protein, 11 aa, Artificial Sequence
  source: /note="Description of Artificial Sequence: Synthetic peptide"
QSLVHNNGVTY

SEQ ID NO: 214 - protein, 11 aa, Artificial Sequence
  source: /note="Description of Artificial Sequence: Synthetic peptide"
QSLVHSNGNTY

SEQ ID NO: 215 - protein, 11 aa, Artificial Sequence
  source: /note="Description of Artificial Sequence: Synthetic peptide"
QSLVHSNGNTY

SEQ ID NO: 216 - protein, 10 aa, Artificial Sequence
  source: /note="Description of Artificial Sequence: Synthetic peptide"
KSVSTSGYSY

SEQ ID NO: 217 - protein, 11 aa, Artificial Sequence
  source: /note="Description of Artificial Sequence: Synthetic peptide"
QSLLYSNGKTY

SEQ ID NO: 218 - protein, 11 aa, Artificial Sequence
  source: /note="Description of Artificial Sequence: Synthetic peptide"
QSLIHSNGNNY

SEQ ID NO: 219 - protein, 12 aa, Artificial Sequence
  source: /note="Description of Artificial Sequence: Synthetic peptide"
QSLLNSSSQKNY

SEQ ID NO: 220 - protein, 11 aa, Artificial Sequence
  source: /note="Description of Artificial Sequence: Synthetic peptide"
QSLIHSNGNNY

SEQ ID NO: 221 - protein, 11 aa, Artificial Sequence
  source: /note="Description of Artificial Sequence: Synthetic peptide"
QSLVHSNGNIY

SEQ ID NO: 222 - protein, 11 aa, Artificial Sequence
  source: /note="Description of Artificial Sequence: Synthetic peptide"
QSLVHSNGNTY

SEQ ID NO: 223 - protein, 11 aa, Artificial Sequence
  source: /note="Description of Artificial Sequence: Synthetic peptide"
QSLIHSNGNNY

SEQ ID NO: 224 - protein, 11 aa, Artificial Sequence
  source: /note="Description of Artificial Sequence: Synthetic peptide"
QSLIHSNGNNY

SEQ ID NO: 225 - protein, 11 aa, Artificial Sequence
  source: /note="Description of Artificial Sequence: Synthetic peptide"
QSLIHSNGNNY

SEQ ID NO: 226 - protein, 11 aa, Artificial Sequence
  source: /note="Description of Artificial Sequence: Synthetic peptide"
QSLVHSSGNTY

SEQ ID NO: 227 - protein, 11 aa, Artificial Sequence
  source: /note="Description of Artificial Sequence: Synthetic peptide"
QRLVHSNGNTY

SEQ ID NO: 228 - protein, 11 aa, Artificial Sequence
  source: /note="Description of Artificial Sequence: Synthetic peptide"
QSLVHSSENTY

SEQ ID NO: 229 - protein, 11 aa, Artificial Sequence
  source: /note="Description of Artificial Sequence: Synthetic peptide"
QSLVHSNGNTY

SEQ ID NO: 230 - protein, 11 aa, Artificial Sequence
  source: /note="Description of Artificial Sequence: Synthetic peptide"
QSLVHSSENTY

SEQ ID NO: 231 - protein, 11 aa, Artificial Sequence
  source: /note="Description of Artificial Sequence: Synthetic peptide"
QSLVHSNGNTY

SEQ ID NO: 232 - protein, 11 aa, Artificial Sequence
  source: /note="Description of Artificial Sequence: Synthetic peptide"
QSLVHSSGNTY

SEQ ID NO: 233 - protein, 6 aa, Artificial Sequence
  source: /note="Description of Artificial Sequence: Synthetic peptide"
QEISGY

SEQ ID NO: 234 - protein, 6 aa, Artificial Sequence
  source: /note="Description of Artificial Sequence: Synthetic peptide"
QNIYVW

SEQ ID NO: 235 - protein, 11 aa, Artificial Sequence
  source: /note="Description of Artificial Sequence: Synthetic peptide"
QSLVHSNGNTY

SEQ ID NO: 236 - protein, 11 aa, Artificial Sequence
  source: /note="Description of Artificial Sequence: Synthetic peptide"
QSLVHSNGNTY

SEQ ID NO: 237 - protein, 11 aa, Artificial Sequence
  source: /note="Description of Artificial Sequence: Synthetic peptide"
QSIVYSNGNTY

SEQ ID NO: 238 - protein, 11 aa, Artificial Sequence
  source: /note="Description of Artificial Sequence: Synthetic peptide"
QSLLYSNGKTY

SEQ ID NO: 239 - protein, 6 aa, Artificial Sequence
  source: /note="Description of Artificial Sequence: Synthetic peptide"
QDISNY

SEQ ID NO: 240 - protein, 6 aa, Artificial Sequence
  source: /note="Description of Artificial Sequence: Synthetic peptide"
QNIDVW

SEQ ID NO: 241 - protein, 7 aa, Artificial Sequence
  source: /note="Description of Artificial Sequence: Synthetic peptide"
ISPGDGD

SEQ ID NO: 242 - protein, 7 aa, Artificial Sequence
  source: /note="Description of Artificial Sequence: Synthetic peptide"
ISPGDGD

SEQ ID NO: 243 - protein, 7 aa, Artificial Sequence
  source: /note="Description of Artificial Sequence: Synthetic peptide"
ISPGNGE

SEQ ID NO: 244 - protein, 6 aa, Artificial Sequence
  source: /note="Description of Artificial Sequence: Synthetic peptide"
IWTGGG

SEQ ID NO: 245 - protein, 7 aa, Artificial Sequence
  source: /note="Description of Artificial Sequence: Synthetic peptide"
IYPGDGD

SEQ ID NO: 246 - protein, 7 aa, Artificial Sequence
  source: /note="Description of Artificial Sequence: Synthetic peptide"
INTYSGV

SEQ ID NO: 247 - protein, 7 aa, Artificial Sequence
  source: /note="Description of Artificial Sequence: Synthetic peptide"
IYPGDGD

SEQ ID NO: 248 - protein, 7 aa, Artificial Sequence
  source: /note="Description of Artificial Sequence: Synthetic peptide"
INPSSGY

SEQ ID NO: 249 - protein, 7 aa, Artificial Sequence
  source: /note="Description of Artificial Sequence: Synthetic peptide"
IDPSDGY

SEQ ID NO: 250 - protein, 7 aa, Artificial Sequence
  source: /note="Description of Artificial Sequence: Synthetic peptide"
IDPSDSY

SEQ ID NO: 251 - protein, 7 aa, Artificial Sequence
  source: /note="Description of Artificial Sequence: Synthetic peptide"
ISPGNGD

SEQ ID NO: 252 - protein, 7 aa, Artificial Sequence
  source: /note="Description of Artificial Sequence: Synthetic peptide"
LNPSSGY

SEQ ID NO: 253 - protein, 6 aa, Artificial Sequence
  source: /note="Description of Artificial Sequence: Synthetic peptide"
IWRGGS

SEQ ID NO: 254 - protein, 7 aa, Artificial Sequence
  source: /note="Description of Artificial Sequence: Synthetic peptide"
ISPGNGD

SEQ ID NO: 255 - protein, 7 aa, Artificial Sequence
  source: /note="Description of Artificial Sequence: Synthetic peptide"
ISPGNGD

SEQ ID NO: 256 - protein, 9 aa, Artificial Sequence
  source: /note="Description of Artificial Sequence: Synthetic peptide"
IRNKANNHA

SEQ ID NO: 257 - protein, 6 aa, Artificial Sequence
  source: /note="Description of Artificial Sequence: Synthetic peptide"
IWSGGS

SEQ ID NO: 258 - protein, 7 aa, Artificial Sequence
  source: /note="Description of Artificial Sequence: Synthetic peptide"
IHPNSNS

SEQ ID NO: 259 - protein, 7 aa, Artificial Sequence
  source: /note="Description of Artificial Sequence: Synthetic peptide"
INPNNGG

SEQ ID NO: 260 - protein, 7 aa, Artificial Sequence
  source: /note="Description of Artificial Sequence: Synthetic peptide"
INPYNDG

SEQ ID NO: 261 - protein, 7 aa, Artificial Sequence
  source: /note="Description of Artificial Sequence: Synthetic peptide"
IYPGRGT

SEQ ID NO: 262 - protein, 7 aa, Artificial Sequence
  source: /note="Description of Artificial Sequence: Synthetic peptide"
FYPGSGS

SEQ ID NO: 263 - protein, 7 aa, Artificial Sequence
  source: /note="Description of Artificial Sequence: Synthetic peptide"
ITSGGTH

SEQ ID NO: 264 - protein, 7 aa, Artificial Sequence
  source: /note="Description of Artificial Sequence: Synthetic peptide"
INTNSGM

SEQ ID NO: 265 - protein, 7 aa, Artificial Sequence
  source: /note="Description of Artificial Sequence: Synthetic peptide"
INPRSDY

SEQ ID NO: 266 - protein, 7 aa, Artificial Sequence
  source: /note="Description of Artificial Sequence: Synthetic peptide"
INPRGDY

SEQ ID NO: 267 - protein, 7 aa, Artificial Sequence
  source: /note="Description of Artificial Sequence: Synthetic peptide"
INPRGDY

SEQ ID NO: 268 - protein, 7 aa, Artificial Sequence
  source: /note="Description of Artificial Sequence: Synthetic peptide"
INTYSGV

SEQ ID NO: 269 - protein, 6 aa, Artificial Sequence
  source: /note="Description of Artificial Sequence: Synthetic peptide"
IWSDGS

SEQ ID NO: 270 - protein, 6 aa, Artificial Sequence
  source: /note="Description of Artificial Sequence: Synthetic peptide"
IWGVGS

SEQ ID NO: 271 - protein, 7 aa, Artificial Sequence
  source: /note="Description of Artificial Sequence: Synthetic peptide"
INPSTTS

SEQ ID NO: 272 - protein, 6 aa, Artificial Sequence
  source: /note="Description of Artificial Sequence: Synthetic peptide"
IWGVGG

SEQ ID NO: 273 - protein, 7 aa, Artificial Sequence
  source: /note="Description of Artificial Sequence: Synthetic peptide"
INPSTDY

SEQ ID NO: 274 - protein, 6 aa, Artificial Sequence
  source: /note="Description of Artificial Sequence: Synthetic peptide"
IWSDGS

SEQ ID NO: 275 - protein, 6 aa, Artificial Sequence
  source: /note="Description of Artificial Sequence: Synthetic peptide"
IHYSGS

SEQ ID NO: 276 - protein, 6 aa, Artificial Sequence
  source: /note="Description of Artificial Sequence: Synthetic peptide"
INYSGS

SEQ ID NO: 277 - protein, 7 aa, Artificial Sequence
  source: /note="Description of Artificial Sequence: Synthetic peptide"
ISSGGSY

SEQ ID NO: 278 - protein, 7 aa, Artificial Sequence
  source: /note="Description of Artificial Sequence: Synthetic peptide"
INPSSAS

SEQ ID NO: 279 - protein, 7 aa, Artificial Sequence
  source: /note="Description of Artificial Sequence: Synthetic peptide"
INPSSGY

SEQ ID NO: 280 - protein, 7 aa, Artificial Sequence
  source: /note="Description of Artificial Sequence: Synthetic peptide"
INPSSGY

SEQ ID NO: 281 - protein, 7 aa, Artificial Sequence
  source: /note="Description of Artificial Sequence: Synthetic peptide"
INPSGDY

SEQ ID NO: 282 - protein, 7 aa, Artificial Sequence
  source: /note="Description of Artificial Sequence: Synthetic peptide"
INPINGF

SEQ ID NO: 283 - protein, 7 aa, Artificial Sequence
  source: /note="Description of Artificial Sequence: Synthetic peptide"
INPINGF

SEQ ID NO: 284 - protein, 7 aa, Artificial Sequence
  source: /note="Description of Artificial Sequence: Synthetic peptide"
INPINGY

SEQ ID NO: 285 - protein, 7 aa, Artificial Sequence
  source: /note="Description of Artificial Sequence: Synthetic peptide"
FYPNNGG

SEQ ID NO: 286 - protein, 6 aa, Artificial Sequence
  source: /note="Description of Artificial Sequence: Synthetic peptide"
IWGDGI

SEQ ID NO: 287 - protein, 7 aa, Artificial Sequence
  source: /note="Description of Artificial Sequence: Synthetic peptide"
FYPNNGG

SEQ ID NO: 288 - protein, 6 aa, Artificial Sequence
  source: /note="Description of Artificial Sequence: Synthetic peptide"
IWGDGL

SEQ ID NO: 289 - protein, 7 aa, Artificial Sequence
  source: /note="Description of Artificial Sequence: Synthetic peptide"
FYPNNGG

SEQ ID NO: 290 - protein, 6 aa, Artificial Sequence
  source: /note="Description of Artificial Sequence: Synthetic peptide"
IWGDGL

SEQ ID NO: 291 - protein, 7 aa, Artificial Sequence
  source: /note="Description of Artificial Sequence: Synthetic peptide"
FYPNNDG

SEQ ID NO: 292 - protein, 6 aa, Artificial Sequence
  source: /note="Description of Artificial Sequence: Synthetic peptide"
ISYSGR

SEQ ID NO: 293 - protein, 7 aa, Artificial Sequence
  source: /note="Description of Artificial Sequence: Synthetic peptide"
IDPTNVN

SEQ ID NO: 294 - protein, 6 aa, Artificial Sequence
  source: /note="Description of Artificial Sequence: Synthetic peptide"
ISYSGR

SEQ ID NO: 295 - protein, 6 aa, Artificial Sequence
  source: /note="Description of Artificial Sequence: Synthetic peptide"
ISYSGR

SEQ ID NO: 296 - protein, 6 aa, Artificial Sequence
  source: /note="Description of Artificial Sequence: Synthetic peptide"
ISTGGN

SEQ ID NO: 297 - protein, 6 aa, Artificial Sequence
  source: /note="Description of Artificial Sequence: Synthetic peptide"
IHNSGS

SEQ ID NO: 298 - protein, 6 aa, Artificial Sequence
  source: /note="Description of Artificial Sequence: Synthetic peptide"
ISYSGS

SEQ ID NO: 299 - protein, 6 aa, Artificial Sequence
  source: /note="Description of Artificial Sequence: Synthetic peptide"
IHYSGR

SEQ ID NO: 300 - protein, 6 aa, Artificial Sequence
  source: /note="Description of Artificial Sequence: Synthetic peptide"
ISYSGS

SEQ ID NO: 301 - protein, 7 aa, Artificial Sequence
  source: /note="Description of Artificial Sequence: Synthetic peptide"
LYPGDDD

SEQ ID NO: 302 - protein, 2 aa, Artificial Sequence
  source: /note="Description of Artificial Sequence: Synthetic peptide"
KV

SEQ ID NO: 303 - protein, 2 aa, Artificial Sequence
  source: /note="Description of Artificial Sequence: Synthetic peptide"
SS

SEQ ID NO: 304 - protein, 2 aa, Artificial Sequence
  source: /note="Description of Artificial Sequence: Synthetic peptide"
KV

SEQ ID NO: 305 - protein, 2 aa, Artificial Sequence
  source: /note="Description of Artificial Sequence: Synthetic peptide"
LV

SEQ ID NO: 306 - protein, 2 aa, Artificial Sequence
  source: /note="Description of Artificial Sequence: Synthetic peptide"
LV

SEQ ID NO: 307 - protein, 2 aa, Artificial Sequence
  source: /note="Description of Artificial Sequence: Synthetic peptide"
LV

SEQ ID NO: 308 - protein, 2 aa, Artificial Sequence
  source: /note="Description of Artificial Sequence: Synthetic peptide"
SA

SEQ ID NO: 309 - protein, 2 aa, Artificial Sequence
  source: /note="Description of Artificial Sequence: Synthetic peptide"
GA

SEQ ID NO: 310 - protein, 2 aa, Artificial Sequence
  source: /note="Description of Artificial Sequence: Synthetic peptide"
WA

SEQ ID NO: 311 - protein, 2 aa, Artificial Sequence
  source: /note="Description of Artificial Sequence: Synthetic peptide"
SA

SEQ ID NO: 312 - protein, 2 aa, Artificial Sequence
  source: /note="Description of Artificial Sequence: Synthetic peptide"
KV

SEQ ID NO: 313 - protein, 2 aa, Artificial Sequence
  source: /note="Description of Artificial Sequence: Synthetic peptide"
WA

SEQ ID NO: 314 - protein, 2 aa, Artificial Sequence
  source: /note="Description of Artificial Sequence: Synthetic peptide"
SA

SEQ ID NO: 315 - protein, 2 aa, Artificial Sequence
  source: /note="Description of Artificial Sequence: Synthetic peptide"
SA

SEQ ID NO: 316 - protein, 2 aa, Artificial Sequence
  source: /note="Description of Artificial Sequence: Synthetic peptide"
WA

SEQ ID NO: 317 - protein, 2 aa, Artificial Sequence
  source: /note="Description of Artificial Sequence: Synthetic peptide"
YA

SEQ ID NO: 318 - protein, 2 aa, Artificial Sequence
  source: /note="Description of Artificial Sequence: Synthetic peptide"
SA

SEQ ID NO: 319 - protein, 2 aa, Artificial Sequence
  source: /note="Description of Artificial Sequence: Synthetic peptide"
GA

SEQ ID NO: 320 - protein, 2 aa, Artificial Sequence
  source: /note="Description of Artificial Sequence: Synthetic peptide"
LV

SEQ ID NO: 321 - protein, 2 aa, Artificial Sequence
  source: /note="Description of Artificial Sequence: Synthetic peptide"
AA

SEQ ID NO: 322 - protein, 2 aa, Artificial Sequence
  source: /note="Description of Artificial Sequence: Synthetic peptide"
SG

SEQ ID NO: 323 - protein, 2 aa, Artificial Sequence
  source: /note="Description of Artificial Sequence: Synthetic peptide"
SA

SEQ ID NO: 324 - protein, 2 aa, Artificial Sequence
  source: /note="Description of Artificial Sequence: Synthetic peptide"
LV

SEQ ID NO: 325 - protein, 2 aa, Artificial Sequence
  source: /note="Description of Artificial Sequence: Synthetic peptide"
KV

SEQ ID NO: 326 - protein, 2 aa, Artificial Sequence
  source: /note="Description of Artificial Sequence: Synthetic peptide"
KV

SEQ ID NO: 327 - protein, 2 aa, Artificial Sequence
  source: /note="Description of Artificial Sequence: Synthetic peptide"
KV

SEQ ID NO: 328 - protein, 2 aa, Artificial Sequence
  source: /note="Description of Artificial Sequence: Synthetic peptide"
ST

SEQ ID NO: 329 - protein, 2 aa, Artificial Sequence
  source: /note="Description of Artificial Sequence: Synthetic peptide"
WA

SEQ ID NO: 330 - protein, 2 aa, Artificial Sequence
  source: /note="Description of Artificial Sequence: Synthetic peptide"
RV

SEQ ID NO: 331 - protein, 2 aa, Artificial Sequence
  source: /note="Description of Artificial Sequence: Synthetic peptide"
KV

SEQ ID NO: 332 - protein, 2 aa, Artificial Sequence
  source: /note="Description of Artificial Sequence: Synthetic peptide"
KV

SEQ ID NO: 333 - protein, 2 aa, Artificial Sequence
  source: /note="Description of Artificial Sequence: Synthetic peptide"
KV

SEQ ID NO: 334 - protein, 2 aa, Artificial Sequence
  source: /note="Description of Artificial Sequence: Synthetic peptide"
KV

SEQ ID NO: 335 - protein, 2 aa, Artificial Sequence
  source: /note="Description of Artificial Sequence: Synthetic peptide"
KV

SEQ ID NO: 336 - protein, 2 aa, Artificial Sequence
  source: /note="Description of Artificial Sequence: Synthetic peptide"
LA

SEQ ID NO: 337 - protein, 2 aa, Artificial Sequence
  source: /note="Description of Artificial Sequence: Synthetic peptide"
LV

SEQ ID NO: 338 - protein, 2 aa, Artificial Sequence
  source: /note="Description of Artificial Sequence: Synthetic peptide"
TV

SEQ ID NO: 339 - protein, 2 aa, Artificial Sequence
  source: /note="Description of Artificial Sequence: Synthetic peptide"
FA

SEQ ID NO: 340 - protein, 2 aa, Artificial Sequence
  source: /note="Description of Artificial Sequence: Synthetic peptide"
KV

SEQ ID NO: 341 - protein, 2 aa, Artificial Sequence
  source: /note="Description of Artificial Sequence: Synthetic peptide"
KV

SEQ ID NO: 342 - protein, 2 aa, Artificial Sequence
  source: /note="Description of Artificial Sequence: Synthetic peptide"
KV

SEQ ID NO: 343 - protein, 2 aa, Artificial Sequence
  source: /note="Description of Artificial Sequence: Synthetic peptide"
KV

SEQ ID NO: 344 - protein, 2 aa, Artificial Sequence
  source: /note="Description of Artificial Sequence: Synthetic peptide"
TV

SEQ ID NO: 345 - protein, 2 aa, Artificial Sequence
  source: /note="Description of Artificial Sequence: Synthetic peptide"
TV

SEQ ID NO: 346 - protein, 2 aa, Artificial Sequence
  source: /note="Description of Artificial Sequence: Synthetic peptide"
KV

SEQ ID NO: 347 - protein, 2 aa, Artificial Sequence
  source: /note="Description of Artificial Sequence: Synthetic peptide"
KV

SEQ ID NO: 348 - protein, 2 aa, Artificial Sequence
  source: /note="Description of Artificial Sequence: Synthetic peptide"
KV

SEQ ID NO: 349 - protein, 2 aa, Artificial Sequence
  source: /note="Description of Artificial Sequence: Synthetic peptide"
KV

SEQ ID NO: 350 - protein, 2 aa, Artificial Sequence
  source: /note="Description of Artificial Sequence: Synthetic peptide"
KV

SEQ ID NO: 351 - protein, 2 aa, Artificial Sequence
  source: /note="Description of Artificial Sequence: Synthetic peptide"
KV

SEQ ID NO: 352 - protein, 2 aa, Artificial Sequence
  source: /note="Description of Artificial Sequence: Synthetic peptide"
KV

SEQ ID NO: 353 - protein, 2 aa, Artificial Sequence
  source: /note="Description of Artificial Sequence: Synthetic peptide"
AA

SEQ ID NO: 354 - protein, 2 aa, Artificial Sequence
  source: /note="Description of Artificial Sequence: Synthetic peptide"
KA

SEQ ID NO: 355 - protein, 2 aa, Artificial Sequence
  source: /note="Description of Artificial Sequence: Synthetic peptide"
KV

SEQ ID NO: 356 - protein, 2 aa, Artificial Sequence
  source: /note="Description of Artificial Sequence: Synthetic peptide"
KV

SEQ ID NO: 357 - protein, 2 aa, Artificial Sequence
  source: /note="Description of Artificial Sequence: Synthetic peptide"
KV

SEQ ID NO: 358 - protein, 2 aa, Artificial Sequence
  source: /note="Description of Artificial Sequence: Synthetic peptide"
LV

SEQ ID NO: 359 - protein, 2 aa, Artificial Sequence
  source: /note="Description of Artificial Sequence: Synthetic peptide"
QI

SEQ ID NO: 360 - protein, 2 aa, Artificial Sequence
  source: /note="Description of Artificial Sequence: Synthetic peptide"
KA

SEQ ID NO: 361 - protein, 17 aa, Artificial Sequence
  source: /note="Description of Artificial Sequence: Synthetic peptide"
VRRFLITSTRYVMDYWG

SEQ ID NO: 362 - protein, 16 aa, Artificial Sequence
  source: /note="Description of Artificial Sequence: Synthetic peptide"
VRFLITSTRYVMDYWG

SEQ ID NO: 363 - protein, 18 aa, Artificial Sequence
  source: /note="Description of Artificial Sequence: Synthetic peptide"
KRALFYYTGKYQPMDYWG

SEQ ID NO: 364 - protein, 15 aa, Artificial Sequence
  source: /note="Description of Artificial Sequence: Synthetic peptide"
ARDGDYVYYAMAYWG

SEQ ID NO: 365 - protein, 8 aa, Artificial Sequence
  source: /note="Description of Artificial Sequence: Synthetic peptide"
TRSLGVWG

SEQ ID NO: 366 - protein, 12 aa, Artificial Sequence
  source: /note="Description of Artificial Sequence: Synthetic peptide"
ARGLGRLLAYWG

SEQ ID NO: 367 - protein, 8 aa, Artificial Sequence
  source: /note="Description of Artificial Sequence: Synthetic peptide"
TRSLGVWG

SEQ ID NO: 368 - protein, 11 aa, Artificial Sequence
  source: /note="Description of Artificial Sequence: Synthetic peptide"
ARGMFAMDYWG

SEQ ID NO: 369 - protein, 7 aa, Artificial Sequence
  source: /note="Description of Artificial Sequence: Synthetic peptide"
ATEGFWG

SEQ ID NO: 370 - protein, 16 aa, Artificial Sequence
  source: /note="Description of Artificial Sequence: Synthetic peptide"
ARVAYYSNFGGFAYWG

SEQ ID NO: 371 - protein, 18 aa, Artificial Sequence
  source: /note="Description of Artificial Sequence: Synthetic peptide"
KGPLFVRGQYYITMDYWG

SEQ ID NO: 372 - protein, 18 aa, Artificial Sequence
  source: /note="Description of Artificial Sequence: Synthetic peptide"
TRSGGDNYGNPYYFDRWG

SEQ ID NO: 373 - protein, 14 aa, Artificial Sequence
  source: /note="Description of Artificial Sequence: Synthetic peptide"
AKNSQLGNAMDYWG

SEQ ID NO: 374 - protein, 18 aa, Artificial Sequence
  source: /note="Description of Artificial Sequence: Synthetic peptide"
KGPLLLRWRYFYPVDYWG

SEQ ID NO: 375 - protein, 18 aa, Artificial Sequence
  source: /note="Description of Artificial Sequence: Synthetic peptide"
KGPLLVRWRYYITMDYWG

SEQ ID NO: 376 - protein, 12 aa, Artificial Sequence
  source: /note="Description of Artificial Sequence: Synthetic peptide"
TRGGYYVFAYWG

SEQ ID NO: 377 - protein, 14 aa, Artificial Sequence
  source: /note="Description of Artificial Sequence: Synthetic peptide"
AKNSQLGNAMDYWG

SEQ ID NO: 378 - protein, 12 aa, Artificial Sequence
  source: /note="Description of Artificial Sequence: Synthetic peptide"
ARSLTGTKTYWG

SEQ ID NO: 379 - protein, 11 aa, Artificial Sequence
  source: /note="Description of Artificial Sequence: Synthetic peptide"
AHGEGDYAYWG

SEQ ID NO: 380 - protein, 10 aa, Artificial Sequence
  source: /note="Description of Artificial Sequence: Synthetic peptide"
ATARATSYWG

SEQ ID NO: 381 - protein, 12 aa, Artificial Sequence
  source: /note="Description of Artificial Sequence: Synthetic peptide"
ARWGTTGRSYWG

SEQ ID NO: 382 - protein, 16 aa, Artificial Sequence
  source: /note="Description of Artificial Sequence: Synthetic peptide"
ARHGNYYDGSWFAYWG

SEQ ID NO: 383 - protein, 16 aa, Artificial Sequence
  source: /note="Description of Artificial Sequence: Synthetic peptide"
TRHGAYYSNPWFAYWG

SEQ ID NO: 384 - protein, 9 aa, Artificial Sequence
  source: /note="Description of Artificial Sequence: Synthetic peptide"
ARKSLFYWG

SEQ ID NO: 385 - protein, 16 aa, Artificial Sequence
  source: /note="Description of Artificial Sequence: Synthetic peptide"
ARVTGTEGPYYFDYWG

SEQ ID NO: 386 - protein, 16 aa, Artificial Sequence
  source: /note="Description of Artificial Sequence: Synthetic peptide"
VRVTGSEGPYYFDYWG

SEQ ID NO: 387 - protein, 16 aa, Artificial Sequence
  source: /note="Description of Artificial Sequence: Synthetic peptide"
ARVTGTEGPYYFDYWG

SEQ ID NO: 388 - protein, 13 aa, Artificial Sequence
  source: /note="Description of Artificial Sequence: Synthetic peptide"
ARSRYDGYFDYWG

SEQ ID NO: 389 - protein, 14 aa, Artificial Sequence
  source: /note="Description of Artificial Sequence: Synthetic peptide"
ARNGRLGNAMDYWG

SEQ ID NO: 390 - protein, 15 aa, Artificial Sequence
  source: /note="Description of Artificial Sequence: Synthetic peptide"
ASPYYSHYVPFAYWG

SEQ ID NO: 391 - protein, 15 aa, Artificial Sequence
  source: /note="Description of Artificial Sequence: Synthetic peptide"
ARPDNSGYVGFAYWG

SEQ ID NO: 392 - protein, 15 aa, Artificial Sequence
  source: /note="Description of Artificial Sequence: Synthetic peptide"
ASPYYSHYVPFAYWG

SEQ ID NO: 393 - protein, 11 aa, Artificial Sequence
  source: /note="Description of Artificial Sequence: Synthetic peptide"
AGGLPHFDYWG

SEQ ID NO: 394 - protein, 14 aa, Artificial Sequence
  source: /note="Description of Artificial Sequence: Synthetic peptide"
ARNSRYGNSFAYWG

SEQ ID NO: 395 - protein, 10 aa, Artificial Sequence
  source: /note="Description of Artificial Sequence: Synthetic peptide"
VFWLPFDYWG

SEQ ID NO: 396 - protein, 14 aa, Artificial Sequence
  source: /note="Description of Artificial Sequence: Synthetic peptide"
ARMGYRYPWFAYWG

SEQ ID NO: 397 - protein, 14 aa, Artificial Sequence
  source: /note="Description of Artificial Sequence: Synthetic peptide"
TRGGGNYDAMDYWG

SEQ ID NO: 398 - protein, 20 aa, Artificial Sequence
  source: /note="Description of Artificial Sequence: Synthetic peptide"
ARVPLPYGSSYGPYFFDFWG

SEQ ID NO: 399 - protein, 13 aa, Artificial Sequence
  source: /note="Description of Artificial Sequence: Synthetic peptide"
ARSGDYDGFAYWG

SEQ ID NO: 400 - protein, 20 aa, Artificial Sequence
  source: /note="Description of Artificial Sequence: Synthetic peptide"
ARVPLSYGSSYGPYFFDYWG

SEQ ID NO: 401 - protein, 20 aa, Artificial Sequence
  source: /note="Description of Artificial Sequence: Synthetic peptide"
ARVPLSYGSGNGPYYFDYWG

SEQ ID NO: 402 - protein, 20 aa, Artificial Sequence
  source: /note="Description of Artificial Sequence: Synthetic peptide"
ARVPLSYGGSYGPYFFDFWG

SEQ ID NO: 403 - protein, 20 aa, Artificial Sequence
  source: /note="Description of Artificial Sequence: Synthetic peptide"
ARVPLSYGGSYGPYFFDFWG

SEQ ID NO: 404 - protein, 20 aa, Artificial Sequence
  source: /note="Description of Artificial Sequence: Synthetic peptide"
ARVPLSYGGSYGPYFFDFWG

SEQ ID NO: 405 - protein, 11 aa, Artificial Sequence
  source: /note="Description of Artificial Sequence: Synthetic peptide"
TRGSGPFAYWG

SEQ ID NO: 406 - protein, 15 aa, Artificial Sequence
  source: /note="Description of Artificial Sequence: Synthetic peptide"
ASALDYSNYGFAYWG

SEQ ID NO: 407 - protein, 11 aa, Artificial Sequence
  source: /note="Description of Artificial Sequence: Synthetic peptide"
TRGSGPFAYWG

SEQ ID NO: 408 - protein, 15 aa, Artificial Sequence
  source: /note="Description of Artificial Sequence: Synthetic peptide"
ASALDYSNYGFAYWG

SEQ ID NO: 409 - protein, 11 aa, Artificial Sequence
  source: /note="Description of Artificial Sequence: Synthetic peptide"
TRGSGPFAYWG

SEQ ID NO: 410 - protein, 15 aa, Artificial Sequence
  source: /note="Description of Artificial Sequence: Synthetic peptide"
ASALDYSNFGFAYWG

SEQ ID NO: 411 - protein, 11 aa, Artificial Sequence
  source: /note="Description of Artificial Sequence: Synthetic peptide"
ARGSGPFVYWG

SEQ ID NO: 412 - protein, 11 aa, Artificial Sequence
  source: /note="Description of Artificial Sequence: Synthetic peptide"
ARASIGFDYWG

SEQ ID NO: 413 - protein, 14 aa, Artificial Sequence
  source: /note="Description of Artificial Sequence: Synthetic peptide"
ARRLRQTYAMDYWG

SEQ ID NO: 414 - protein, 11 aa, Artificial Sequence
  source: /note="Description of Artificial Sequence: Synthetic peptide"
ARASIGFDYWG

SEQ ID NO: 415 - protein, 11 aa, Artificial Sequence
  source: /note="Description of Artificial Sequence: Synthetic peptide"
ARASIGFDYWG

SEQ ID NO: 416 - protein, 14 aa, Artificial Sequence
  source: /note="Description of Artificial Sequence: Synthetic peptide"
TRGYQRFSGFAYWG

SEQ ID NO: 417 - protein, 9 aa, Artificial Sequence
  source: /note="Description of Artificial Sequence: Synthetic peptide"
ARSIGDYWG

SEQ ID NO: 418 - protein, 16 aa, Artificial Sequence
  source: /note="Description of Artificial Sequence: Synthetic peptide"
ARYGGNYPTYAMDYWG

SEQ ID NO: 419 - protein, 9 aa, Artificial Sequence
  source: /note="Description of Artificial Sequence: Synthetic peptide"
ARYDFAYWG

SEQ ID NO: 420 - protein, 12 aa, Artificial Sequence
  source: /note="Description of Artificial Sequence: Synthetic peptide"
AITTGGYFDYWG

SEQ ID NO: 421 - protein, 15 aa, Artificial Sequence
  source: /note="Description of Artificial Sequence: Synthetic peptide"
AVTEVKRRRSFAYWG

SEQ ID NO: 422 - protein, 11 aa, Artificial Sequence
  source: /note="Description of Artificial Sequence: Synthetic peptide"
SQSTLVPPTFG

SEQ ID NO: 423 - protein, 11 aa, Artificial Sequence
  source: /note="Description of Artificial Sequence: Synthetic peptide"
QQYNSFPLTFG

SEQ ID NO: 424 - protein, 11 aa, Artificial Sequence
  source: /note="Description of Artificial Sequence: Synthetic peptide"
SQSTHVPPTFG

SEQ ID NO: 425 - protein, 11 aa, Artificial Sequence
  source: /note="Description of Artificial Sequence: Synthetic peptide"
VQGTHVPYTFG

SEQ ID NO: 426 - protein, 11 aa, Artificial Sequence
  source: /note="Description of Artificial Sequence: Synthetic peptide"
VQGTHVPYTFG

SEQ ID NO: 427 - protein, 11 aa, Artificial Sequence
  source: /note="Description of Artificial Sequence: Synthetic peptide"
LQATHFPWTFG

SEQ ID NO: 428 - protein, 11 aa, Artificial Sequence
  source: /note="Description of Artificial Sequence: Synthetic peptide"
QQYSSSPYTFG

SEQ ID NO: 429 - protein, 11 aa, Artificial Sequence
  source: /note="Description of Artificial Sequence: Synthetic peptide"
QNDHSHPYTFG

SEQ ID NO: 430 - protein, 10 aa, Artificial Sequence
  source: /note="Description of Artificial Sequence: Synthetic peptide"
KQSYNLYTFG

SEQ ID NO: 431 - protein, 11 aa, Artificial Sequence
  source: /note="Description of Artificial Sequence: Synthetic peptide"
QQYNSFPLTFG

SEQ ID NO: 432 - protein, 11 aa, Artificial Sequence
  source: /note="Description of Artificial Sequence: Synthetic peptide"
SQSTLVPLTFG

SEQ ID NO: 433 - protein, 10 aa, Artificial Sequence
  source: /note="Description of Artificial Sequence: Synthetic peptide"
NQSYDLLTFG

SEQ ID NO: 434 - protein, 11 aa, Artificial Sequence
  source: /note="Description of Artificial Sequence: Synthetic peptide"
QQYNSFPLTFG

SEQ ID NO: 435 - protein, 11 aa, Artificial Sequence
  source: /note="Description of Artificial Sequence: Synthetic peptide"
QQYNSFPLTFG

SEQ ID NO: 436 - protein, 10 aa, Artificial Sequence
  source: /note="Description of Artificial Sequence: Synthetic peptide"
NQSYDLLTFG

SEQ ID NO: 437 - protein, 11 aa, Artificial Sequence
  source: /note="Description of Artificial Sequence: Synthetic peptide"
QNGHSFPPTFG

SEQ ID NO: 438 - protein, 11 aa, Artificial Sequence
  source: /note="Description of Artificial Sequence: Synthetic peptide"
QQYNSFPLTFG

SEQ ID NO: 439 - protein, 11 aa, Artificial Sequence
  source: /note="Description of Artificial Sequence: Synthetic peptide"
QQYWSTPYTFG

SEQ ID NO: 440 - protein, 11 aa, Artificial Sequence
  source: /note="Description of Artificial Sequence: Synthetic peptide"
LQATHFPHTFG

SEQ ID NO: 441 - protein, 11 aa, Artificial Sequence
  source: /note="Description of Artificial Sequence: Synthetic peptide"
LQYASYPWTFG

SEQ ID NO: 442 - protein, 11 aa, Artificial Sequence
  source: /note="Description of Artificial Sequence: Synthetic peptide"
QQHDEYPWTFG

SEQ ID NO: 443 - protein, 11 aa, Artificial Sequence
  source: /note="Description of Artificial Sequence: Synthetic peptide"
QQYNSSPWTFG

SEQ ID NO: 444 - protein, 11 aa, Artificial Sequence
  source: /note="Description of Artificial Sequence: Synthetic peptide"
WQGTHFPWTFG

SEQ ID NO: 445 - protein, 11 aa, Artificial Sequence
  source: /note="Description of Artificial Sequence: Synthetic peptide"
SQSTLVPLTFG

SEQ ID NO: 446 - protein, 11 aa, Artificial Sequence
  source: /note="Description of Artificial Sequence: Synthetic peptide"
SQSTLVPLTFG

SEQ ID NO: 447 - protein, 11 aa, Artificial Sequence
  source: /note="Description of Artificial Sequence: Synthetic peptide"
SQSTLVPLTFG

SEQ ID NO: 448 - protein, 11 aa, Artificial Sequence
  source: /note="Description of Artificial Sequence: Synthetic peptide"
QQRSSYPPTFG

SEQ ID NO: 449 - protein, 10 aa, Artificial Sequence
  source: /note="Description of Artificial Sequence: Synthetic peptide"
KQSYNLLTFG

SEQ ID NO: 450 - protein, 11 aa, Artificial Sequence
  source: /note="Description of Artificial Sequence: Synthetic peptide"
SQSTHVPPTFG

SEQ ID NO: 451 - protein, 11 aa, Artificial Sequence
  source: /note="Description of Artificial Sequence: Synthetic peptide"
SQSTLVPLTFG

SEQ ID NO: 452 - protein, 11 aa, Artificial Sequence
  source: /note="Description of Artificial Sequence: Synthetic peptide"
SQSTLVPPTFG

SEQ ID NO: 453 - protein, 11 aa, Artificial Sequence
  source: /note="Description of Artificial Sequence: Synthetic peptide"
SQSTHVPITFG

SEQ ID NO: 454 - protein, 11 aa, Artificial Sequence
  source: /note="Description of Artificial Sequence: Synthetic peptide"
SQSTHVPFTFG

SEQ ID NO: 455 - protein, 11 aa, Artificial Sequence
  source: /note="Description of Artificial Sequence: Synthetic peptide"
SQSTHVPYTFG

SEQ ID NO: 456 - protein, 11 aa, Artificial Sequence
  source: /note="Description of Artificial Sequence: Synthetic peptide"
QHNRELPPTFG

SEQ ID NO: 457 - protein, 11 aa, Artificial Sequence
  source: /note="Description of Artificial Sequence: Synthetic peptide"
VQGTHFPHTFG

SEQ ID NO: 458 - protein, 11 aa, Artificial Sequence
  source: /note="Description of Artificial Sequence: Synthetic peptide"
SQSTLVPLTFG

SEQ ID NO: 459 - protein, 11 aa, Artificial Sequence
  source: /note="Description of Artificial Sequence: Synthetic peptide"
QQHYSTPPTFG

SEQ ID NO: 460 - protein, 11 aa, Artificial Sequence
  source: /note="Description of Artificial Sequence: Synthetic peptide"
SQSTLVPLTFG

SEQ ID NO: 461 - protein, 11 aa, Artificial Sequence
  source: /note="Description of Artificial Sequence: Synthetic peptide"
SQSTLVPLTFG

SEQ ID NO: 462 - protein, 11 aa, Artificial Sequence
  source: /note="Description of Artificial Sequence: Synthetic peptide"
SQSTLVPLTFG

SEQ ID NO: 463 - protein, 11 aa, Artificial Sequence
  source: /note="Description of Artificial Sequence: Synthetic peptide"
SQSTLVPLTFG

SEQ ID NO: 464 - protein, 11 aa, Artificial Sequence
  source: /note="Description of Artificial Sequence: Synthetic peptide"
SQSTLVPLTFG

SEQ ID NO: 465 - protein, 11 aa, Artificial Sequence
  source: /note="Description of Artificial Sequence: Synthetic peptide"
SQSTLVPLTFG

SEQ ID NO: 466 - protein, 11 aa, Artificial Sequence
  source: /note="Description of Artificial Sequence: Synthetic peptide"
SQSTLVPVTFG

SEQ ID NO: 467 - protein, 11 aa, Artificial Sequence
  source: /note="Description of Artificial Sequence: Synthetic peptide"
AQSTLVPPTFG

SEQ ID NO: 468 - protein, 11 aa, Artificial Sequence
  source: /note="Description of Artificial Sequence: Synthetic peptide"
SQSTLVPVTFG

SEQ ID NO: 469 - protein, 11 aa, Artificial Sequence
  source: /note="Description of Artificial Sequence: Synthetic peptide"
AQSTLVPPTFG

SEQ ID NO: 470 - protein, 11 aa, Artificial Sequence
  source: /note="Description of Artificial Sequence: Synthetic peptide"
SQSTLVPVTFG

SEQ ID NO: 471 - protein, 11 aa, Artificial Sequence
  source: /note="Description of Artificial Sequence: Synthetic peptide"
AQSTLVPPTFG

SEQ ID NO: 472 - protein, 11 aa, Artificial Sequence
  source: /note="Description of Artificial Sequence: Synthetic peptide"
SQSTLIPLTFG

SEQ ID NO: 473 - protein, 11 aa, Artificial Sequence
  source: /note="Description of Artificial Sequence: Synthetic peptide"
LHYANYPPTFG

SEQ ID NO: 474 - protein, 11 aa, Artificial Sequence
  source: /note="Description of Artificial Sequence: Synthetic peptide"
QQGLSYPLTFG

SEQ ID NO: 475 - protein, 11 aa, Artificial Sequence
  source: /note="Description of Artificial Sequence: Synthetic peptide"
SQSTHVPYTFG

SEQ ID NO: 476 - protein, 11 aa, Artificial Sequence
  source: /note="Description of Artificial Sequence: Synthetic peptide"
SQSTHVPWTFG

SEQ ID NO: 477 - protein, 11 aa, Artificial Sequence
  source: /note="Description of Artificial Sequence: Synthetic peptide"
FQGSHVPPTFG

SEQ ID NO: 478 - protein, 11 aa, Artificial Sequence
  source: /note="Description of Artificial Sequence: Synthetic peptide"
VQNTHLPYTFG

SEQ ID NO: 479 - protein, 11 aa, Artificial Sequence
  source: /note="Description of Artificial Sequence: Synthetic peptide"
QQGNSLPPTFG

SEQ ID NO: 480 - protein, 11 aa, Artificial Sequence
  source: /note="Description of Artificial Sequence: Synthetic peptide"
QQGHSYPLTFG

SEQ ID NO: 481 - protein, 122 aa, Artificial Sequence; identical to SEQ ID NO: 1
  source: /note="Description of Artificial Sequence: Synthetic polypeptide"

SEQ ID NO: 482 - protein, 121 aa, Artificial Sequence; identical to SEQ ID NO: 2
  source: /note="Description of Artificial Sequence: Synthetic polypeptide"

SEQ ID NO: 483 - protein, 123 aa, Artificial Sequence; identical to SEQ ID NO: 3
  source: /note="Description of Artificial Sequence: Synthetic polypeptide"

SEQ ID NO: 484 - protein, 119 aa, Artificial Sequence; identical to SEQ ID NO: 4
  source: /note="Description of Artificial Sequence: Synthetic polypeptide"

SEQ ID NO: 485 - protein, 113 aa, Artificial Sequence; identical to SEQ ID NO: 5
  source: /note="Description of Artificial Sequence: Synthetic polypeptide"

SEQ ID NO: 486 - protein, 117 aa, Artificial Sequence; identical to SEQ ID NO: 6
  source: /note="Description of Artificial Sequence: Synthetic polypeptide"

SEQ ID NO: 487 - protein, 113 aa, Artificial Sequence; identical to SEQ ID NO: 7
  source: /note="Description of Artificial Sequence: Synthetic polypeptide"

SEQ ID NO: 488 - protein, 116 aa, Artificial Sequence; identical to SEQ ID NO: 8
  source: /note="Description of Artificial Sequence: Synthetic polypeptide"

SEQ ID NO: 489 - protein, 112 aa, Artificial Sequence; identical to SEQ ID NO: 9
  source: /note="Description of Artificial Sequence: Synthetic polypeptide"

SEQ ID NO: 490 - protein, 121 aa, Artificial Sequence; identical to SEQ ID NO: 10
  source: /note="Description of Artificial Sequence: Synthetic polypeptide"

SEQ ID NO: 491 - protein, 123 aa, Artificial Sequence; identical to SEQ ID NO: 11
  source: /note="Description of Artificial Sequence: Synthetic polypeptide"

SEQ ID NO: 492 - protein, 123 aa, Artificial Sequence; identical to SEQ ID NO: 12
  source: /note="Description of Artificial Sequence: Synthetic polypeptide"

SEQ ID NO: 493 - protein, 118 aa, Artificial Sequence; identical to SEQ ID NO: 13
  source: /note="Description of Artificial Sequence: Synthetic polypeptide"

SEQ ID NO: 494 - protein, 123 aa, Artificial Sequence; identical to SEQ ID NO: 14
  source: /note="Description of Artificial Sequence: Synthetic polypeptide"

SEQ ID NO: 495 - protein, 123 aa, Artificial Sequence; identical to SEQ ID NO: 15
  source: /note="Description of Artificial Sequence: Synthetic polypeptide"

SEQ ID NO: 496 - protein, 119 aa, Artificial Sequence; identical to SEQ ID NO: 16
  source: /note="Description of Artificial Sequence: Synthetic polypeptide"

SEQ ID NO: 497 - protein, 118 aa, Artificial Sequence; identical to SEQ ID NO: 17
  source: /note="Description of Artificial Sequence: Synthetic polypeptide"

SEQ ID NO: 498 - protein, 117 aa, Artificial Sequence; identical to SEQ ID NO: 18
  source: /note="Description of Artificial Sequence: Synthetic polypeptide"

SEQ ID NO: 499 - protein, 116 aa, Artificial Sequence; identical to SEQ ID NO: 19
  source: /note="Description of Artificial Sequence: Synthetic polypeptide"

SEQ ID NO: 500 - protein, 115 aa, Artificial Sequence; identical to SEQ ID NO: 20
  source: /note="Description of Artificial Sequence: Synthetic polypeptide"

SEQ ID NO: 501 - protein, 117 aa, Artificial Sequence; identical to SEQ ID NO: 21
  source: /note="Description of Artificial Sequence: Synthetic polypeptide"

SEQ ID NO: 502 - protein, 121 aa, Artificial Sequence; identical to SEQ ID NO: 22
  source: /note="Description of Artificial Sequence: Synthetic polypeptide"

SEQ ID NO: 503 - protein, 120 aa, Artificial Sequence; identical to SEQ ID NO: 23
  source: /note="Description of Artificial Sequence: Synthetic polypeptide"

SEQ ID NO: 504 - protein, 114 aa, Artificial Sequence; identical to SEQ ID NO: 24
  source: /note="Description of Artificial Sequence: Synthetic polypeptide"

SEQ ID NO: 505 - protein, 121 aa, Artificial Sequence; identical to SEQ ID NO: 25
  source: /note="Description of Artificial Sequence: Synthetic polypeptide"

SEQ ID NO: 506 - protein, 121 aa, Artificial Sequence; identical to SEQ ID NO: 26
  source: /note="Description of Artificial Sequence: Synthetic polypeptide"

SEQ ID NO: 507 - protein, 121 aa, Artificial Sequence; identical to SEQ ID NO: 27
  source: /note="Description of Artificial Sequence: Synthetic polypeptide"

SEQ ID NO: 508 - protein, 118 aa, Artificial Sequence; identical to SEQ ID NO: 28
  source: /note="Description of Artificial Sequence: Synthetic polypeptide"

SEQ ID NO: 509 - protein, 118 aa, Artificial Sequence; identical to SEQ ID NO: 29
  source: /note="Description of Artificial Sequence: Synthetic polypeptide"

SEQ ID NO: 510 - protein, 119 aa, Artificial Sequence; identical to SEQ ID NO: 30
  source: /note="Description of Artificial Sequence: Synthetic polypeptide"

SEQ ID NO: 511 - protein, 120 aa, Artificial Sequence; identical to SEQ ID NO: 31
  source: /note="Description of Artificial Sequence: Synthetic polypeptide"

SEQ ID NO: 512 - protein, 119 aa, Artificial Sequence; identical to SEQ ID NO: 32
  source: /note="Description of Artificial Sequence: Synthetic polypeptide"

SEQ ID NO: 513 - protein, 116 aa, Artificial Sequence; identical to SEQ ID NO: 33
  source: /note="Description of Artificial Sequence: Synthetic polypeptide"

SEQ ID NO: 514 - protein, 118 aa, Artificial Sequence; identical to SEQ ID NO: 34
  source: /note="Description of Artificial Sequence: Synthetic polypeptide"

SEQ ID NO: 515 - protein, 115 aa, Artificial Sequence; identical to SEQ ID NO: 35
  source: /note="Description of Artificial Sequence: Synthetic polypeptide"

SEQ ID NO: 516 - protein, 119 aa, Artificial Sequence; identical to SEQ ID NO: 36
  source: /note="Description of Artificial Sequence: Synthetic polypeptide"

SEQ ID NO: 517 - protein, 119 aa, Artificial Sequence; identical to SEQ ID NO: 37
  source: /note="Description of Artificial Sequence: Synthetic polypeptide"

SEQ ID NO: 518 - protein, 125 aa, Artificial Sequence; identical to SEQ ID NO: 38
  source: /note="Description of Artificial Sequence: Synthetic polypeptide"

SEQ ID NO: 519 - protein, 118 aa, Artificial Sequence; identical to SEQ ID NO: 39
  source: /note="Description of Artificial Sequence: Synthetic polypeptide"

SEQ ID NO: 520 - protein, 125 aa, Artificial Sequence; identical to SEQ ID NO: 40
  source: /note="Description of Artificial Sequence: Synthetic polypeptide"

SEQ ID NO: 521 - protein, 125 aa, Artificial Sequence; identical to SEQ ID NO: 41
  source: /note="Description of Artificial Sequence: Synthetic polypeptide"

SEQ ID NO: 522 - protein, 125 aa, Artificial Sequence; identical to SEQ ID NO: 42
  source: /note="Description of Artificial Sequence: Synthetic polypeptide"

SEQ ID NO: 523 - protein, 125 aa, Artificial Sequence; identical to SEQ ID NO: 43
  source: /note="Description of Artificial Sequence: Synthetic polypeptide"

SEQ ID NO: 524 - protein, 125 aa, Artificial Sequence; identical to SEQ ID NO: 44
  source: /note="Description of Artificial Sequence: Synthetic polypeptide"

SEQ ID NO: 525 - protein, 116 aa, Artificial Sequence; identical to SEQ ID NO: 45
  source: /note="Description of Artificial Sequence: Synthetic polypeptide"

SEQ ID NO: 526 - protein, 119 aa, Artificial Sequence; identical to SEQ ID NO: 46
  source: /note="Description of Artificial Sequence: Synthetic polypeptide"

SEQ ID NO: 527 - protein, 116 aa, Artificial Sequence; identical to SEQ ID NO: 47
  source: /note="Description of Artificial Sequence: Synthetic polypeptide"

SEQ ID NO: 528 - protein, 119 aa, Artificial Sequence; identical to SEQ ID NO: 48
  source: /note="Description of Artificial Sequence: Synthetic polypeptide"

SEQ ID NO: 529 - protein, 116 aa, Artificial Sequence; identical to SEQ ID NO: 49
  source: /note="Description of Artificial Sequence: Synthetic polypeptide"

SEQ ID NO: 530 - protein, 119 aa, Artificial Sequence; identical to SEQ ID NO: 50
  source: /note="Description of Artificial Sequence: Synthetic polypeptide"

SEQ ID NO: 531 - protein, 116 aa, Artificial Sequence; identical to SEQ ID NO: 51
  source: /note="Description of Artificial Sequence: Synthetic polypeptide"

SEQ ID NO: 532 - protein, 116 aa, Artificial Sequence; identical to SEQ ID NO: 52
  source: /note="Description of Artificial Sequence: Synthetic polypeptide"

SEQ ID NO: 533 - protein, 119 aa, Artificial Sequence; identical to SEQ ID NO: 53
  source: /note="Description of Artificial Sequence: Synthetic polypeptide"

SEQ ID NO: 534 - protein, 116 aa, Artificial Sequence; identical to SEQ ID NO: 54
  source: /note="Description of Artificial Sequence: Synthetic polypeptide"

SEQ ID NO: 535 - protein, 116 aa, Artificial Sequence; identical to SEQ ID NO: 55
  source: /note="Description of Artificial Sequence: Synthetic polypeptide"

SEQ ID NO: 536 - protein, 117 aa, Artificial Sequence; identical to SEQ ID NO: 56
  source: /note="Description of Artificial Sequence: Synthetic polypeptide"

SEQ ID NO: 537 - protein, 114 aa, Artificial Sequence; identical to SEQ ID NO: 57
  source: /note="Description of Artificial Sequence: Synthetic polypeptide"

SEQ ID NO: 538 - protein, 121 aa, Artificial Sequence; identical to SEQ ID NO: 58
  source: /note="Description of Artificial Sequence: Synthetic polypeptide"

SEQ ID NO: 539 - protein, 114 aa, Artificial Sequence; identical to SEQ ID NO: 59
  source: /note="Description of Artificial Sequence: Synthetic polypeptide"

SEQ ID NO: 540 - protein, 117 aa, Artificial Sequence; identical to SEQ ID NO: 60
  source: /note="Description of Artificial Sequence: Synthetic polypeptide"

SEQ ID NO: 541 - protein, 120 aa, Artificial Sequence; identical to SEQ ID NO: 61
  source: /note="Description of Artificial Sequence: Synthetic polypeptide"

SEQ ID NO: 542 - protein, 112 aa, Artificial Sequence; identical to SEQ ID NO: 62
  source: /note="Description of Artificial Sequence: Synthetic polypeptide"

SEQ ID NO: 543 - protein, 107 aa, Artificial Sequence; identical to SEQ ID NO: 63
  source: /note="Description of Artificial Sequence: Synthetic polypeptide"

SEQ ID NO: 544 - protein, 112 aa, Artificial Sequence; identical to SEQ ID NO: 64
  source: /note="Description of Artificial Sequence: Synthetic polypeptide"

SEQ ID NO: 545 - protein, 112 aa, Artificial Sequence; identical to SEQ ID NO: 65
  source: /note="Description of Artificial Sequence: Synthetic polypeptide"

SEQ ID NO: 546 - protein, 112 aa, Artificial Sequence; identical to SEQ ID NO: 66
  source: /note="Description of Artificial Sequence: Synthetic polypeptide"

SEQ ID NO: 547 - protein, 112 aa, Artificial Sequence; identical to SEQ ID NO: 67
  source: /note="Description of Artificial Sequence: Synthetic polypeptide"

SEQ ID NO: 548 - protein, 107 aa, Artificial Sequence; identical to SEQ ID NO: 68
  source: /note="Description of Artificial Sequence: Synthetic polypeptide"

SEQ ID NO: 549 - protein, 113 aa, Artificial Sequence; identical to SEQ ID NO: 69
  source: /note="Description of Artificial Sequence: Synthetic polypeptide"

SEQ ID NO: 550 - protein, 112 aa, Artificial Sequence; identical to SEQ ID NO: 70
  source: /note="Description of Artificial Sequence: Synthetic polypeptide"

SEQ ID NO: 551 - protein, 107 aa, Artificial Sequence; identical to SEQ ID NO: 71
  source: /note="Description of Artificial Sequence: Synthetic polypeptide"

SEQ ID NO: 552 - protein, 112 aa, Artificial Sequence; identical to SEQ ID NO: 72
  source: /note="Description of Artificial Sequence: Synthetic polypeptide"

SEQ ID NO: 553 - protein, 112 aa, Artificial Sequence; identical to SEQ ID NO: 73
  source: /note="Description of Artificial Sequence: Synthetic polypeptide"

SEQ ID NO: 554 - protein, 107 aa, Artificial Sequence; identical to SEQ ID NO: 74
  source: /note="Description of Artificial Sequence: Synthetic polypeptide"

SEQ ID NO: 555 - protein, 107 aa, Artificial Sequence; identical to SEQ ID NO: 75
  source: /note="Description of Artificial Sequence: Synthetic polypeptide"

SEQ ID NO: 556 - protein, 112 aa, Artificial Sequence; identical to SEQ ID NO: 76
  source: /note="Description of Artificial Sequence: Synthetic polypeptide"

SEQ ID NO: 557 - protein, 107 aa, Artificial Sequence; identical to SEQ ID NO: 77
  source: /note="Description of Artificial Sequence: Synthetic polypeptide"

SEQ ID NO: 558 - protein, 107 aa, Artificial Sequence; identical to SEQ ID NO: 78
  source: /note="Description of Artificial Sequence: Synthetic polypeptide"

SEQ ID NO: 559 - protein, 107 aa, Artificial Sequence; identical to SEQ ID NO: 79
  source: /note="Description of Artificial Sequence: Synthetic polypeptide"

SEQ ID NO: 560 - protein, 112 aa, Artificial Sequence; identical to SEQ ID NO: 80
  source: /note="Description of Artificial Sequence: Synthetic polypeptide"

SEQ ID NO: 561 - protein, 107 aa, Artificial Sequence; identical to SEQ ID NO: 81
  source: /note="Description of Artificial Sequence: Synthetic polypeptide"

SEQ ID NO: 562 - protein, 107 aa, Artificial Sequence; identical to SEQ ID NO: 82
  source: /note="Description of Artificial Sequence: Synthetic polypeptide"

SEQ ID NO: 563 - protein, 107 aa, Artificial Sequence; identical to SEQ ID NO: 83
  source: /note="Description of Artificial Sequence: Synthetic polypeptide"

SEQ ID NO: 564 - protein, 112 aa, Artificial Sequence; identical to SEQ ID NO: 84
  source: /note="Description of Artificial Sequence: Synthetic polypeptide"

SEQ ID NO: 565 - protein, 112 aa, Artificial Sequence; identical to SEQ ID NO: 85
  source: /note="Description of Artificial Sequence: Synthetic polypeptide"

SEQ ID NO: 566 - protein, 112 aa, Artificial Sequence; identical to SEQ ID NO: 86
  source: /note="Description of Artificial Sequence: Synthetic polypeptide"

SEQ ID NO: 567 - protein, 112 aa, Artificial Sequence; identical to SEQ ID NO: 87
  source: /note="Description of Artificial Sequence: Synthetic polypeptide"

SEQ ID NO: 568 - protein, 106 aa, Artificial Sequence; identical to SEQ ID NO: 88
  source: /note="Description of Artificial Sequence: Synthetic polypeptide"

SEQ ID NO: 569 - protein, 111 aa, Artificial Sequence; identical to SEQ ID NO: 89
  source: /note="Description of Artificial Sequence: Synthetic polypeptide"

SEQ ID NO: 570 - protein, 112 aa, Artificial Sequence; identical to SEQ ID NO: 90
  source: /note="Description of Artificial Sequence: Synthetic polypeptide"

SEQ ID NO: 571 - protein, 112 aa, Artificial Sequence; identical to SEQ ID NO: 91
  source: /note="Description of Artificial Sequence: Synthetic polypeptide"

SEQ ID NO: 572 - protein, 112 aa, Artificial Sequence; identical to SEQ ID NO: 92
  source: /note="Description of Artificial Sequence: Synthetic polypeptide"

SEQ ID NO: 573 - protein, 112 aa, Artificial Sequence; identical to SEQ ID NO: 93
  source: /note="Description of Artificial Sequence: Synthetic polypeptide"

SEQ ID NO: 574 - protein, 112 aa, Artificial Sequence; identical to SEQ ID NO: 94
  source: /note="Description of Artificial Sequence: Synthetic polypeptide"

SEQ ID NO: 575 - protein, 112 aa, Artificial Sequence; identical to SEQ ID NO: 95
  source: /note="Description of Artificial Sequence: Synthetic polypeptide"

SEQ ID NO: 576 - protein, 111 aa, Artificial Sequence; identical to SEQ ID NO: 96
  source: /note="Description of Artificial Sequence: Synthetic polypeptide"

SEQ ID NO: 577 - protein, 112 aa, Artificial Sequence; identical to SEQ ID NO: 97
  source: /note="Description of Artificial Sequence: Synthetic polypeptide"

SEQ ID NO: 578 - protein, 112 aa, Artificial Sequence; identical to SEQ ID NO: 98
  source: /note="Description of Artificial Sequence: Synthetic polypeptide"

SEQ ID NO: 579 - protein, 113 aa, Artificial Sequence; identical to SEQ ID NO: 99
  source: /note="Description of Artificial Sequence: Synthetic polypeptide"

SEQ ID NO: 580 - protein, 112 aa, Artificial Sequence; identical to SEQ ID NO: 100
  source: /note="Description of Artificial Sequence: Synthetic polypeptide"

SEQ ID NO: 581 - protein, 112 aa, Artificial Sequence; identical to SEQ ID NO: 101
  source: /note="Description of Artificial Sequence: Synthetic polypeptide"

SEQ ID NO: 582 - protein, 112 aa, Artificial Sequence; identical to SEQ ID NO: 102
  source: /note="Description of Artificial Sequence: Synthetic polypeptide"

SEQ ID NO: 583 - protein, 112 aa, Artificial Sequence; identical to SEQ ID NO: 103
  source: /note="Description of Artificial Sequence: Synthetic polypeptide"

SEQ ID NO: 584 - protein, 112 aa, Artificial Sequence; identical to SEQ ID NO: 104
  source: /note="Description of Artificial Sequence: Synthetic polypeptide"

SEQ ID NO: 585 - protein, 112 aa, Artificial Sequence; identical to SEQ ID NO: 105
  source: /note="Description of Artificial Sequence: Synthetic polypeptide"

SEQ ID NO: 586 - protein, 112 aa, Artificial Sequence; identical to SEQ ID NO: 106
  source: /note="Description of Artificial Sequence: Synthetic polypeptide"

SEQ ID NO: 587 - protein, 112 aa, Artificial Sequence; identical to SEQ ID NO: 107
  source: /note="Description of Artificial Sequence: Synthetic polypeptide"

SEQ ID NO: 588 - protein, 112 aa, Artificial Sequence; identical to SEQ ID NO: 108
  source: /note="Description of Artificial Sequence: Synthetic polypeptide"

SEQ ID NO: 589 - protein, 112 aa, Artificial Sequence; identical to SEQ ID NO: 109
  source: /note="Description of Artificial Sequence: Synthetic polypeptide"

SEQ ID NO: 590 - protein, 112 aa, Artificial Sequence; identical to SEQ ID NO: 110
  source: /note="Description of Artificial Sequence: Synthetic polypeptide"

SEQ ID NO: 591 - protein, 112 aa, Artificial Sequence; identical to SEQ ID NO: 111
  source: /note="Description of Artificial Sequence: Synthetic polypeptide"

SEQ ID NO: 592 - protein, 111 aa, Artificial Sequence; identical to SEQ ID NO: 112
  source: /note="Description of Artificial Sequence: Synthetic polypeptide"

SEQ ID NO: 593 - protein, 107 aa, Artificial Sequence; identical to SEQ ID NO: 113
  source: /note="Description of Artificial Sequence: Synthetic polypeptide"

SEQ ID NO: 594 - protein, 107 aa, Artificial Sequence; identical to SEQ ID NO: 114
  source: /note="Description of Artificial Sequence: Synthetic polypeptide"

SEQ ID NO: 595 - protein, 112 aa, Artificial Sequence; identical to SEQ ID NO: 115
  source: /note="Description of Artificial Sequence: Synthetic polypeptide"

SEQ ID NO: 596 - protein, 112 aa, Artificial Sequence; identical to SEQ ID NO: 116
  source: /note="Description of Artificial Sequence: Synthetic polypeptide"

SEQ ID NO: 597 - protein, 112 aa, Artificial Sequence; identical to SEQ ID NO: 117
  source: /note="Description of Artificial Sequence: Synthetic polypeptide"

SEQ ID NO: 598 - protein, 112 aa, Artificial Sequence; identical to SEQ ID NO: 118
  source: /note="Description of Artificial Sequence: Synthetic polypeptide"

SEQ ID NO: 599 - protein, 107 aa, Artificial Sequence; identical to SEQ ID NO: 119
  source: /note="Description of Artificial Sequence: Synthetic polypeptide"

SEQ ID NO: 600 - protein, 107 aa, Artificial Sequence; identical to SEQ ID NO: 120
  source: /note="Description of Artificial Sequence: Synthetic polypeptide"

SEQ ID NO: 601 - protein, 7 aa, Artificial Sequence
  source: /note="Description of Artificial Sequence: Synthetic peptide"
GYSFSSS

SEQ ID NO: 602 - protein, 7 aa, Artificial Sequence
  source: /note="Description of Artificial Sequence: Synthetic peptide"
GYSFSSS

SEQ ID NO: 603 - protein, 7 aa, Artificial Sequence
  source: /note="Description of Artificial Sequence: Synthetic peptide"
GYTFIDH

SEQ ID NO: 604 - protein, 7 aa, Artificial Sequence
  source: /note="Description of Artificial Sequence: Synthetic peptide"
GFSLTSY

SEQ ID NO: 605 - protein, 7 aa, Artificial Sequence
  source: /note="Description of Artificial Sequence: Synthetic peptide"
GYAFSRY

SEQ ID NO: 606 - protein, 7 aa, Artificial Sequence
  source: /note="Description of Artificial Sequence: Synthetic peptide"
GYSFTTF

SEQ ID NO: 607 - protein, 7 aa, Artificial Sequence
  source: /note="Description of Artificial Sequence: Synthetic peptide"
GYAFSSY

SEQ ID NO: 608 - protein, 7 aa, Artificial Sequence
  source: /note="Description of Artificial Sequence: Synthetic peptide"
GYTFTSY

SEQ ID NO: 609 - protein, 7 aa, Artificial Sequence
  source: /note="Description of Artificial Sequence: Synthetic peptide"
GYTFTSY

SEQ ID NO: 610 - protein, 7 aa, Artificial Sequence
  source: /note="Description of Artificial Sequence: Synthetic peptide"
GYTFTSY

SEQ ID NO: 611 - protein, 7 aa, Artificial Sequence
  source: /note="Description of Artificial Sequence: Synthetic peptide"
GHTFTDH

SEQ ID NO: 612 - protein, 7 aa, Artificial Sequence
  source: /note="Description of Artificial Sequence: Synthetic peptide"
GYTFTNY

SEQ ID NO: 613 - protein, 7 aa, Artificial Sequence
  source: /note="Description of Artificial Sequence: Synthetic peptide"
GFSLTSY

SEQ ID NO: 614 - protein, 7 aa, Artificial Sequence
  source: /note="Description of Artificial Sequence: Synthetic peptide"
GYTFTDH

SEQ ID NO: 615 - protein, 7 aa, Artificial Sequence
  source: /note="Description of Artificial Sequence: Synthetic peptide"
GYTFTDH

SEQ ID NO: 616 - protein, 7 aa, Artificial Sequence
  source: /note="Description of Artificial Sequence: Synthetic peptide"
GFTFSDA

SEQ ID NO: 617 - protein, 7 aa, Artificial Sequence
  source: /note="Description of Artificial Sequence: Synthetic peptide"
GFSLISY

SEQ ID NO: 618 - protein, 7 aa, Artificial Sequence
  source: /note="Description of Artificial Sequence: Synthetic peptide"
GYTFTSY

SEQ ID NO: 619 - protein, 7 aa, Artificial Sequence
  source: /note="Description of Artificial Sequence: Synthetic peptide"
GYTFTDY

SEQ ID NO: 620 - protein, 7 aa, Artificial Sequence
  source: /note="Description of Artificial Sequence: Synthetic peptide"
GYTFTKY

SEQ ID NO: 621 - protein, 7 aa, Artificial Sequence
  source: /note="Description of Artificial Sequence: Synthetic peptide"
GYSFTSY

SEQ ID NO: 622 - protein, 7 aa, Artificial Sequence
  source: /note="Description of Artificial Sequence: Synthetic peptide"
GYTFTEY

SEQ ID NO: 623 - protein, 7 aa, Artificial Sequence
  source: /note="Description of Artificial Sequence: Synthetic peptide"
GFTFSNY

SEQ ID NO: 624 - protein, 7 aa, Artificial Sequence
  source: /note="Description of Artificial Sequence: Synthetic peptide"
GYTFTTF

SEQ ID NO: 625 - protein, 7 aa, Artificial Sequence
  source: /note="Description of Artificial Sequence: Synthetic peptide"
GYTFISY

SEQ ID NO: 626 - protein, 7 aa, Artificial Sequence
  source: /note="Description of Artificial Sequence: Synthetic peptide"
GYTFSSY

SEQ ID NO: 627 - protein, 7 aa, Artificial Sequence
  source: /note="Description of Artificial Sequence: Synthetic peptide"
GYTFTSY

SEQ ID NO: 628 - protein, 7 aa, Artificial Sequence
  source: /note="Description of Artificial Sequence: Synthetic peptide"
GYTFTAY

SEQ ID NO: 629 - protein, 7 aa, Artificial Sequence
  source: /note="Description of Artificial Sequence: Synthetic peptide"
GFSLINS

SEQ ID NO: 630 - protein, 7 aa, Artificial Sequence
  source: /note="Description of Artificial Sequence: Synthetic peptide"
GFSLTSY

SEQ ID NO: 631 - protein, 7 aa, Artificial Sequence
  source: /note="Description of Artificial Sequence: Synthetic peptide"
GYIFTSY

SEQ ID NO: 632 - protein, 7 aa, Artificial Sequence
  source: /note="Description of Artificial Sequence: Synthetic peptide"
GFSLTSY

SEQ ID NO: 633 - protein, 7 aa, Artificial Sequence
  source: /note="Description of Artificial Sequence: Synthetic peptide"
GYSFTRY

SEQ ID NO: 634 - protein, 7 aa, Artificial Sequence
  source: /note="Description of Artificial Sequence: Synthetic peptide"
GFSLTTY

SEQ ID NO: 635 - protein, 8 aa, Artificial Sequence
  source: /note="Description of Artificial Sequence: Synthetic peptide"
GYSITSGY

SEQ ID NO: 636 - protein, 8 aa, Artificial Sequence
  source: /note="Description of Artificial Sequence: Synthetic peptide"
GYSITSDY

SEQ ID NO: 637 - protein, 7 aa, Artificial Sequence
  source: /note="Description of Artificial Sequence: Synthetic peptide"
GFTFSSY

SEQ ID NO: 638 - protein, 7 aa, Artificial Sequence
  source: /note="Description of Artificial Sequence: Synthetic peptide"
GYTFTNY

SEQ ID NO: 639 - protein, 7 aa, Artificial Sequence
  source: /note="Description of Artificial Sequence: Synthetic peptide"
GYTFTSY

SEQ ID NO: 640 - protein, 7 aa, Artificial Sequence
  source: /note="Description of Artificial Sequence: Synthetic peptide"
GYTFTSY

SEQ ID NO: 641 - protein, 7 aa, Artificial Sequence
  source: /note="Description of Artificial Sequence: Synthetic peptide"
GYTFTNY

SEQ ID NO: 642 - protein, 7 aa, Artificial Sequence
  source: /note="Description of Artificial Sequence: Synthetic peptide"
GYTFTNH

SEQ ID NO: 643 - protein, 7 aa, Artificial Sequence
  source: /note="Description of Artificial Sequence: Synthetic peptide"
GYTFTNH

SEQ ID NO: 644 - protein, 7 aa, Artificial Sequence
  source: /note="Description of Artificial Sequence: Synthetic peptide"
GYSFTNY

SEQ ID NO: 645 - protein, 7 aa, Artificial Sequence
  source: /note="Description of Artificial Sequence: Synthetic peptide"
GYTFTDY

SEQ ID NO: 646 - protein, 7 aa, Artificial Sequence
  source: /note="Description of Artificial Sequence: Synthetic peptide"
GFSLTNY

SEQ ID NO: 647 - protein, 7 aa, Artificial Sequence
  source: /note="Description of Artificial Sequence: Synthetic peptide"
GYTFTDY

SEQ ID NO: 648 - protein, 7 aa, Artificial Sequence
  source: /note="Description of Artificial Sequence: Synthetic peptide"
GFSLTNC

SEQ ID NO: 649 - protein, 7 aa, Artificial Sequence
  source: /note="Description of Artificial Sequence: Synthetic peptide"
GYTFTDY

SEQ ID NO: 650 - protein, 7 aa, Artificial Sequence
  source: /note="Description of Artificial Sequence: Synthetic peptide"
GFSLTNC

SEQ ID NO: 651 - protein, 7 aa, Artificial Sequence
  source: /note="Description of Artificial Sequence: Synthetic peptide"
GYTFSDY

SEQ ID NO: 652 - protein, 8 aa, Artificial Sequence
  source: /note="Description of Artificial Sequence: Synthetic peptide"
GYSITSDS

SEQ ID NO: 653 - protein, 7 aa, Artificial Sequence
  source: /note="Description of Artificial Sequence: Synthetic peptide"
GFNIKDS

SEQ ID NO: 654 - protein, 8 aa, Artificial Sequence
  source: /note="Description of Artificial Sequence: Synthetic peptide"
GYSITSDS

SEQ ID NO: 655 - protein, 8 aa, Artificial Sequence
  source: /note="Description of Artificial Sequence: Synthetic peptide"
GYSITSDS

SEQ ID NO: 656 - protein, 7 aa, Artificial Sequence
  source: /note="Description of Artificial Sequence: Synthetic peptide"
GFTFNAY

SEQ ID NO: 657 - protein, 8 aa, Artificial Sequence
  source: /note="Description of Artificial Sequence: Synthetic peptide"
GYSITSGY

SEQ ID NO: 658 - protein, 8 aa, Artificial Sequence
  source: /note="Description of Artificial Sequence: Synthetic peptide"
GYSITSDY

SEQ ID NO: 659 - protein, 8 aa, Artificial Sequence
  source: /note="Description of Artificial Sequence: Synthetic peptide"
GFSLTDSY

SEQ ID NO: 660 - protein, 8 aa, Artificial Sequence
  source: /note="Description of Artificial Sequence: Synthetic peptide"
GYSITSDY

SEQ ID NO: 661 - protein, 7 aa, Artificial Sequence
  source: /note="Description of Artificial Sequence: Synthetic peptide"
GYAFTNF

SEQ ID NO: 662 - protein, 16 aa, Artificial Sequence
  source: /note="Description of Artificial Sequence: Synthetic peptide"
RSSQSLVHSNGNTYLH

SEQ ID NO: 663 - protein, 11 aa, Artificial Sequence
  source: /note="Description of Artificial Sequence: Synthetic peptide"
KASQNVGSAVV

SEQ ID NO: 664 - protein, 16 aa, Artificial Sequence
  source: /note="Description of Artificial Sequence: Synthetic peptide"
RSSQSLVHSNGNTYLH

SEQ ID NO: 665 - protein, 16 aa, Artificial Sequence
  source: /note="Description of Artificial Sequence: Synthetic peptide"
KSSQSLLHSNGKTYLN

SEQ ID NO: 666 - protein, 16 aa, Artificial Sequence
  source: /note="Description of Artificial Sequence: Synthetic peptide"
KSSQSLLHSNGKTYLN

SEQ ID NO: 667 - protein, 16 aa, Artificial Sequence
  source: /note="Description of Artificial Sequence: Synthetic peptide"
KSSQSLLDSDGKTYLN

SEQ ID NO: 668 - protein, 11 aa, Artificial Sequence
  source: /note="Description of Artificial Sequence: Synthetic peptide"
KASQYVGTYVA

SEQ ID NO: 669 - protein, 17 aa, Artificial Sequence
  source: /note="Description of Artificial Sequence: Synthetic peptide"
KSSQSLLKSGNQKNYLA

SEQ ID NO: 670 - protein, 17 aa, Artificial Sequence
  source: /note="Description of Artificial Sequence: Synthetic peptide"
KSSQSLLNSRTRKNYLA

SEQ ID NO: 671 - protein, 11 aa, Artificial Sequence
  source: /note="Description of Artificial Sequence: Synthetic peptide"
KASQNVGAAVV

SEQ ID NO: 672 - protein, 16 aa, Artificial Sequence
  source: /note="Description of Artificial Sequence: Synthetic peptide"
RSSQSLVHSNGNTYLH

SEQ ID NO: 673 - protein, 17 aa, Artificial Sequence
  source: /note="Description of Artificial Sequence: Synthetic peptide"
KSSQSLFNSRTRKNYLA

SEQ ID NO: 674 - protein, 11 aa, Artificial Sequence
  source: /note="Description of Artificial Sequence: Synthetic peptide"
KASQNVGAAVA

SEQ ID NO: 675 - protein, 11 aa, Artificial Sequence
  source: /note="Description of Artificial Sequence: Synthetic peptide"
KASQNVGAAVV

SEQ ID NO: 676 - protein, 17 aa, Artificial Sequence
  source: /note="Description of Artificial Sequence: Synthetic peptide"
KSSQSLLSSRTRKNYLA

SEQ ID NO: 677 - protein, 11 aa, Artificial Sequence
  source: /note="Description of Artificial Sequence: Synthetic peptide"
RASQSISDYLH

SEQ ID NO: 678 - protein, 11 aa, Artificial Sequence
  source: /note="Description of Artificial Sequence: Synthetic peptide"
KASQSVGAAVA

SEQ ID NO: 679 - protein, 11 aa, Artificial Sequence
  source: /note="Description of Artificial Sequence: Synthetic peptide"
KASDHINNWLA

SEQ ID NO: 680 - protein, 16 aa, Artificial Sequence
  source: /note="Description of Artificial Sequence: Synthetic peptide"
KSSQSLLESDGKTYLN

SEQ ID NO: 681 - protein, 11 aa, Artificial Sequence
  source: /note="Description of Artificial Sequence: Synthetic peptide"
RASQEIKTYLS

SEQ ID NO: 682 - protein, 11 aa, Artificial Sequence
  source: /note="Description of Artificial Sequence: Synthetic peptide"
RASKSISKYLA

SEQ ID NO: 683 - protein, 11 aa, Artificial Sequence
  source: /note="Description of Artificial Sequence: Synthetic peptide"
KASQNVGENVS

SEQ ID NO: 684 - protein, 16 aa, Artificial Sequence
  source: /note="Description of Artificial Sequence: Synthetic peptide"
RSSRSLLDSDGKTKLH

SEQ ID NO: 685 - protein, 16 aa, Artificial Sequence
  source: /note="Description of Artificial Sequence: Synthetic peptide"
RSSQSLVHSNGNTYLH

SEQ ID NO: 686 - protein, 16 aa, Artificial Sequence
  source: /note="Description of Artificial Sequence: Synthetic peptide"
RSSQSLVHSNGNTYLQ

SEQ ID NO: 687 - protein, 16 aa, Artificial Sequence
  source: /note="Description of Artificial Sequence: Synthetic peptide"
RSSQSLVHSNGNTYLQ

SEQ ID NO: 688 - protein, 10 aa, Artificial Sequence
  source: /note="Description of Artificial Sequence: Synthetic peptide"
SASSSVSYMH

SEQ ID NO: 689 - protein, 17 aa, Artificial Sequence
  source: /note="Description of Artificial Sequence: Synthetic peptide"
KSSQSLFSSRTRKNYLA

SEQ ID NO: 690 - protein, 16 aa, Artificial Sequence
  source: /note="Description of Artificial Sequence: Synthetic peptide"
RSSQSLVHSNGNTYLH

SEQ ID NO: 691 - protein, 16 aa, Artificial Sequence
  source: /note="Description of Artificial Sequence: Synthetic peptide"
RSSQSLVHSTGNTFLH

SEQ ID NO: 692 - protein, 16 aa, Artificial Sequence
  source: /note="Description of Artificial Sequence: Synthetic peptide"
RSSQSLVHSNGNTYLH

SEQ ID NO: 693 - protein, 16 aa, Artificial Sequence
  source: /note="Description of Artificial Sequence: Synthetic peptide"
RSSQSLVHNNGVTYLH

SEQ ID NO: 694 - protein, 16 aa, Artificial Sequence
  source: /note="Description of Artificial Sequence: Synthetic peptide"
RSSQSLVHSNGNTYLH

SEQ ID NO: 695 - protein, 16 aa, Artificial Sequence
  source: /note="Description of Artificial Sequence: Synthetic peptide"
RSSQSLVHSNGNTYLH

SEQ ID NO: 696 - protein, 15 aa, Artificial Sequence
  source: /note="Description of Artificial Sequence: Synthetic peptide"
RASKSVSTSGYSYLH

SEQ ID NO: 697 - protein, 16 aa, Artificial Sequence
  source: /note="Description of Artificial Sequence: Synthetic peptide"
KSSQSLLYSNGKTYLN

SEQ ID NO: 698 - protein, 16 aa, Artificial Sequence
  source: /note="Description of Artificial Sequence: Synthetic peptide"
RSSQSLIHSNGNNYLH

SEQ ID NO: 699 - protein, 17 aa, Artificial Sequence
  source: /note="Description of Artificial Sequence: Synthetic peptide"
KSSQSLLNSSSQKNYLA

SEQ ID NO: 700 - protein, 16 aa, Artificial Sequence
  source: /note="Description of Artificial Sequence: Synthetic peptide"
RSSQSLIHSNGNNYLH

SEQ ID NO: 701 - protein, 16 aa, Artificial Sequence
  source: /note="Description of Artificial Sequence: Synthetic peptide"
RSSQSLVHSNGNIYLH

SEQ ID NO: 702 - protein, 16 aa, Artificial Sequence
  source: /note="Description of Artificial Sequence: Synthetic peptide"
RSSQSLVHSNGNTYLH

SEQ ID NO: 703 - protein, 16 aa, Artificial Sequence
  source: /note="Description of Artificial Sequence: Synthetic peptide"
RSSQSLIHSNGNNYLH

SEQ ID NO: 704 - protein, 16 aa, Artificial Sequence
  source: /note="Description of Artificial Sequence: Synthetic peptide"
RSSQSLIHSNGNNYLH

SEQ ID NO: 705 - protein, 16 aa, Artificial Sequence
  source: /note="Description of Artificial Sequence: Synthetic peptide"
RSSQSLIHSNGNNYLH

SEQ ID NO: 706 - protein, 16 aa, Artificial Sequence
  source: /note="Description of Artificial Sequence: Synthetic peptide"
RSSQSLVHSSGNTYLH

SEQ ID NO: 707 - protein, 16 aa, Artificial Sequence
  source: /note="Description of Artificial Sequence: Synthetic peptide"
RSSQRLVHSNGNTYLH

SEQ ID NO: 708 - protein, 16 aa, Artificial Sequence
  source: /note="Description of Artificial Sequence: Synthetic peptide"
RSSQSLVHSSENTYLH

SEQ ID NO: 709 - protein, 16 aa, Artificial Sequence
  source: /note="Description of Artificial Sequence: Synthetic peptide"
RSSQSLVHSNGNTYLH

SEQ ID NO: 710 - protein, 16 aa, Artificial Sequence
  source: /note="Description of Artificial Sequence: Synthetic peptide"
RSSQSLVHSSENTYLH

SEQ ID NO: 711 - protein, 16 aa, Artificial Sequence
  source: /note="Description of Artificial Sequence: Synthetic peptide"
RSSQSLVHSNGNTYLH

SEQ ID NO: 712 - protein, 16 aa, Artificial Sequence
  source: /note="Description of Artificial Sequence: Synthetic peptide"
RSSQSLVHSSGNTYLH

SEQ ID NO: 713 - protein, 11 aa, Artificial Sequence
  source: /note="Description of Artificial Sequence: Synthetic peptide"
RASQEISGYLS

SEQ ID NO: 714 - protein, 11 aa, Artificial Sequence
  source: /note="Description of Artificial Sequence: Synthetic peptide"
HASQNIYVWLN

SEQ ID NO: 715 - protein, 16 aa, Artificial Sequence
  source: /note="Description of Artificial Sequence: Synthetic peptide"
RSSQSLVHSNGNTYLN

SEQ ID NO: 716 - protein, 16 aa, Artificial Sequence
  source: /note="Description of Artificial Sequence: Synthetic peptide"
RSGQSLVHSNGNTYLH

SEQ ID NO: 717 - protein, 16 aa, Artificial Sequence
  source: /note="Description of Artificial Sequence: Synthetic peptide"
RFSQSIVYSNGNTYLQ

SEQ ID NO: 718 - protein, 16 aa, Artificial Sequence
  source: /note="Description of Artificial Sequence: Synthetic peptide"
KSSQSLLYSNGKTYLS

SEQ ID NO: 719 - protein, 11 aa, Artificial Sequence
  source: /note="Description of Artificial Sequence: Synthetic peptide"
RASQDISNYLN

SEQ ID NO: 720 - protein, 11 aa, Artificial Sequence
  source: /note="Description of Artificial Sequence: Synthetic peptide"
HASQNIDVWLS

SEQ ID NO: 721 - protein, 6 aa, Artificial Sequence
  source: /note="Description of Artificial Sequence: Synthetic peptide"
SPGDGD

SEQ ID NO: 722 - protein, 6 aa, Artificial Sequence
  source: /note="Description of Artificial Sequence: Synthetic peptide"
SPGDGD

SEQ ID NO: 723 - protein, 6 aa, Artificial Sequence
  source: /note="Description of Artificial Sequence: Synthetic peptide"
SPGNGE

SEQ ID NO: 724 - protein, 5 aa, Artificial Sequence
  source: /note="Description of Artificial Sequence: Synthetic peptide"
WTGGG

SEQ ID NO: 725 - protein, 6 aa, Artificial Sequence
  source: /note="Description of Artificial Sequence: Synthetic peptide"
YPGDGD

SEQ ID NO: 726 - protein, 6 aa, Artificial Sequence
  source: /note="Description of Artificial Sequence: Synthetic peptide"
NTYSGV

SEQ ID NO: 727 - protein, 6 aa, Artificial Sequence
  source: /note="Description of Artificial Sequence: Synthetic peptide"
YPGDGD

SEQ ID NO: 728 - protein, 6 aa, Artificial Sequence
  source: /note="Description of Artificial Sequence: Synthetic peptide"
NPSSGY

SEQ ID NO: 729 - protein, 6 aa, Artificial Sequence
  source: /note="Description of Artificial Sequence: Synthetic peptide"
DPSDGY

SEQ ID NO: 730 - protein, 6 aa, Artificial Sequence
  source: /note="Description of Artificial Sequence: Synthetic peptide"
DPSDSY

SEQ ID NO: 731 - protein, 6 aa, Artificial Sequence
  source: /note="Description of Artificial Sequence: Synthetic peptide"
SPGNGD

SEQ ID NO: 732 - protein, 6 aa, Artificial Sequence
  source: /note="Description of Artificial Sequence: Synthetic peptide"
NPSSGY

SEQ ID NO: 733 - protein, 5 aa, Artificial Sequence
  source: /note="Description of Artificial Sequence: Synthetic peptide"
WRGGS

SEQ ID NO: 734 - protein, 6 aa, Artificial Sequence
  source: /note="Description of Artificial Sequence: Synthetic peptide"
SPGNGD

SEQ ID NO: 735 - protein, 6 aa, Artificial Sequence
  source: /note="Description of Artificial Sequence: Synthetic peptide"
SPGNGD

SEQ ID NO: 736 - protein, 8 aa, Artificial Sequence
  source: /note="Description of Artificial Sequence: Synthetic peptide"
RNKANNHA

SEQ ID NO: 737 - protein, 5 aa, Artificial Sequence
  source: /note="Description of Artificial Sequence: Synthetic peptide"
WSGGS

SEQ ID NO: 738 - protein, 6 aa, Artificial Sequence
  source: /note="Description of Artificial Sequence: Synthetic peptide"
HPNSNS

SEQ ID NO: 739 - protein, 6 aa, Artificial Sequence
  source: /note="Description of Artificial Sequence: Synthetic peptide"
NPNNGG

SEQ ID NO: 740 - protein, 6 aa, Artificial Sequence
  source: /note="Description of Artificial Sequence: Synthetic peptide"
NPYNDG

SEQ ID NO: 741 - protein, 6 aa, Artificial Sequence
  source: /note="Description of Artificial Sequence: Synthetic peptide"
YPGRGT

SEQ ID NO: 742 - protein, 6 aa, Artificial Sequence
  source: /note="Description of Artificial Sequence: Synthetic peptide"
YPGSGS

SEQ ID NO: 743 - protein, 6 aa, Artificial Sequence
  source: /note="Description of Artificial Sequence: Synthetic peptide"
TSGGTH

SEQ ID NO: 744 - protein, 6 aa, Artificial Sequence
  source: /note="Description of Artificial Sequence: Synthetic peptide"
NTNSGM

SEQ ID NO: 745 - protein, 6 aa, Artificial Sequence
  source: /note="Description of Artificial Sequence: Synthetic peptide"
NPRSDY

SEQ ID NO: 746 - protein, 6 aa, Artificial Sequence
  source: /note="Description of Artificial Sequence: Synthetic peptide"
NPRGDY

SEQ ID NO: 747 - protein, 6 aa, Artificial Sequence
  source: /note="Description of Artificial Sequence: Synthetic peptide"
NPRGDY

SEQ ID NO: 748 - protein, 6 aa, Artificial Sequence
  source: /note="Description of Artificial Sequence: Synthetic peptide"
NTYSGV

SEQ ID NO: 749 - protein, 5 aa, Artificial Sequence
  source: /note="Description of Artificial Sequence: Synthetic peptide"
WSDGS

SEQ ID NO: 750 - protein, 5 aa, Artificial Sequence
  source: /note="Description of Artificial Sequence: Synthetic peptide"
WGVGS

SEQ ID NO: 751 - protein, 6 aa, Artificial Sequence
  source: /note="Description of Artificial Sequence: Synthetic peptide"
NPSTTS

SEQ ID NO: 752 - protein, 5 aa, Artificial Sequence
  source: /note="Description of Artificial Sequence: Synthetic peptide"
WGVGG

SEQ ID NO: 753 - protein, 6 aa, Artificial Sequence
  source: /note="Description of Artificial Sequence: Synthetic peptide"
NPSTDY

SEQ ID NO: 754 - protein, 5 aa, Artificial Sequence
  source: /note="Description of Artificial Sequence: Synthetic peptide"
WSDGS

SEQ ID NO: 755 - protein, 5 aa, Artificial Sequence
  source: /note="Description of Artificial Sequence: Synthetic peptide"
HYSGS

SEQ ID NO: 756 - protein, 5 aa, Artificial Sequence
  source: /note="Description of Artificial Sequence: Synthetic peptide"
NYSGS

SEQ ID NO: 757 - protein, 6 aa, Artificial Sequence
  source: /note="Description of Artificial Sequence: Synthetic peptide"
SSGGSY

SEQ ID NO: 758 - protein, 6 aa, Artificial Sequence
  source: /note="Description of Artificial Sequence: Synthetic peptide"
NPSSAS

SEQ ID NO: 759 - protein, 6 aa, Artificial Sequence
  source: /note="Description of Artificial Sequence: Synthetic peptide"
NPSSGY

SEQ ID NO: 760 - protein, 6 aa, Artificial Sequence
  source: /note="Description of Artificial Sequence: Synthetic peptide"
NPSSGY

SEQ ID NO: 761 - protein, 6 aa, Artificial Sequence
  source: /note="Description of Artificial Sequence: Synthetic peptide"
NPSGDY

SEQ ID NO: 762 - protein, 6 aa, Artificial Sequence
  source: /note="Description of Artificial Sequence: Synthetic peptide"
NPINGF

SEQ ID NO: 763 - protein, 6 aa, Artificial Sequence
  source: /note="Description of Artificial Sequence: Synthetic peptide"
NPINGF

SEQ ID NO: 764 - protein, 6 aa, Artificial Sequence
  source: /note="Description of Artificial Sequence: Synthetic peptide"
NPINGY

SEQ ID NO: 765 - protein, 6 aa, Artificial Sequence
  source: /note="Description of Artificial Sequence: Synthetic peptide"
YPNNGG

SEQ ID NO: 766 - protein, 5 aa, Artificial Sequence
  source: /note="Description of Artificial Sequence: Synthetic peptide"
WGDGI

SEQ ID NO: 767 - protein, 6 aa, Artificial Sequence
  source: /note="Description of Artificial Sequence: Synthetic peptide"
YPNNGG

SEQ ID NO: 768 - protein, 5 aa, Artificial Sequence
  source: /note="Description of Artificial Sequence: Synthetic peptide"
WGDGL

SEQ ID NO: 769 - protein, 6 aa, Artificial Sequence
  source: /note="Description of Artificial Sequence: Synthetic peptide"
YPNNGG

SEQ ID NO: 770 - protein, 5 aa, Artificial Sequence
  source: /note="Description of Artificial Sequence: Synthetic peptide"
WGDGL

SEQ ID NO: 771 - protein, 6 aa, Artificial Sequence
  source: /note="Description of Artificial Sequence: Synthetic peptide"
YPNNDG

SEQ ID NO: 772 - protein, 5 aa, Artificial Sequence
  source: /note="Description of Artificial Sequence: Synthetic peptide"
SYSGR

SEQ ID NO: 773 - protein, 6 aa, Artificial Sequence
  source: /note="Description of Artificial Sequence: Synthetic peptide"
DPTNVN

SEQ ID NO: 774 - protein, 5 aa, Artificial Sequence
  source: /note="Description of Artificial Sequence: Synthetic peptide"
SYSGR

SEQ ID NO: 775 - protein, 5 aa, Artificial Sequence
  source: /note="Description of Artificial Sequence: Synthetic peptide"
SYSGR

SEQ ID NO: 776 - protein, 5 aa, Artificial Sequence
  source: /note="Description of Artificial Sequence: Synthetic peptide"
STGGN

SEQ ID NO: 777 - protein, 5 aa, Artificial Sequence
  source: /note="Description of Artificial Sequence: Synthetic peptide"
HNSGS

SEQ ID NO: 778 - protein, 5 aa, Artificial Sequence
  source: /note="Description of Artificial Sequence: Synthetic peptide"
SYSGS

SEQ ID NO: 779 - protein, 5 aa, Artificial Sequence
  source: /note="Description of Artificial Sequence: Synthetic peptide"
HYSGR

SEQ ID NO: 780 - protein, 5 aa, Artificial Sequence
  source: /note="Description of Artificial Sequence: Synthetic peptide"
SYSGS

SEQ ID NO: 781 - protein, 6 aa, Artificial Sequence
  source: /note="Description of Artificial Sequence: Synthetic peptide"
YPGDDD

SEQ ID NO: 782 - protein, 7 aa, Artificial Sequence
  source: /note="Description of Artificial Sequence: Synthetic peptide"
KVSNRFS

SEQ ID NO: 783 - protein, 7 aa, Artificial Sequence
  source: /note="Description of Artificial Sequence: Synthetic peptide"
SSSIRYT

SEQ ID NO: 784 - protein, 7 aa, Artificial Sequence
  source: /note="Description of Artificial Sequence: Synthetic peptide"
KVSNRFS

SEQ ID NO: 785 - protein, 7 aa, Artificial Sequence
  source: /note="Description of Artificial Sequence: Synthetic peptide"
LVSKLDS

SEQ ID NO: 786 - protein, 7 aa, Artificial Sequence
  source: /note="Description of Artificial Sequence: Synthetic peptide"
LVSKLDS

SEQ ID NO: 787 - protein, 7 aa, Artificial Sequence
  source: /note="Description of Artificial Sequence: Synthetic peptide"
LVSKLDS

SEQ ID NO: 788 - protein, 7 aa, Artificial Sequence
  source: /note="Description of Artificial Sequence: Synthetic peptide"
SASYRHT

SEQ ID NO: 789 - protein, 7 aa, Artificial Sequence
  source: /note="Description of Artificial Sequence: Synthetic peptide"
GASTRES

SEQ ID NO: 790 - protein, 7 aa, Artificial Sequence
  source: /note="Description of Artificial Sequence: Synthetic peptide"
WASTRES

SEQ ID NO: 791 - protein, 7 aa, Artificial Sequence
  source: /note="Description of Artificial Sequence: Synthetic peptide"
SASYRYS

SEQ ID NO: 792 - protein, 7 aa, Artificial Sequence
  source: /note="Description of Artificial Sequence: Synthetic peptide"
KVSNRFS

SEQ ID NO: 793 - protein, 7 aa, Artificial Sequence
  source: /note="Description of Artificial Sequence: Synthetic peptide"
WASTRES

SEQ ID NO: 794 - protein, 7 aa, Artificial Sequence
  source: /note="Description of Artificial Sequence: Synthetic peptide"
SASIRYT

SEQ ID NO: 795 - protein, 7 aa, Artificial Sequence
  source: /note="Description of Artificial Sequence: Synthetic peptide"
SASYRYT

SEQ ID NO: 796 - protein, 7 aa, Artificial Sequence
  source: /note="Description of Artificial Sequence: Synthetic peptide"
WASTRES

SEQ ID NO: 797 - protein, 7 aa, Artificial Sequence
  source: /note="Description of Artificial Sequence: Synthetic peptide"
YASQSIS

SEQ ID NO: 798 - protein, 7 aa, Artificial Sequence
  source: /note="Description of Artificial Sequence: Synthetic peptide"
SASIRYA

SEQ ID NO: 799 - protein, 7 aa, Artificial Sequence
  source: /note="Description of Artificial Sequence: Synthetic peptide"
GATSLET

SEQ ID NO: 800 - protein, 7 aa, Artificial Sequence
  source: /note="Description of Artificial Sequence: Synthetic peptide"
LVSKLDS

SEQ ID NO: 801 - protein, 7 aa, Artificial Sequence
  source: /note="Description of Artificial Sequence: Synthetic peptide"
AATTLES

SEQ ID NO: 802 - protein, 7 aa, Artificial Sequence
  source: /note="Description of Artificial Sequence: Synthetic peptide"
SGSTLQS

SEQ ID NO: 803 - protein, 7 aa, Artificial Sequence
  source: /note="Description of Artificial Sequence: Synthetic peptide"
SASYRYS

SEQ ID NO: 804 - protein, 7 aa, Artificial Sequence
  source: /note="Description of Artificial Sequence: Synthetic peptide"
LVSKLDS

SEQ ID NO: 805 - protein, 7 aa, Artificial Sequence
  source: /note="Description of Artificial Sequence: Synthetic peptide"
KVSNRIS

SEQ ID NO: 806 - protein, 7 aa, Artificial Sequence
  source: /note="Description of Artificial Sequence: Synthetic peptide"
KVSNRFS

SEQ ID NO: 807 - protein, 7 aa, Artificial Sequence
  source: /note="Description of Artificial Sequence: Synthetic peptide"
KVSNRFS

SEQ ID NO: 808 - protein, 7 aa, Artificial Sequence
  source: /note="Description of Artificial Sequence: Synthetic peptide"
STSNLAS

SEQ ID NO: 809 - protein, 7 aa, Artificial Sequence
  source: /note="Description of Artificial Sequence: Synthetic peptide"
WASTRES

SEQ ID NO: 810 - protein, 7 aa, Artificial Sequence
  source: /note="Description of Artificial Sequence: Synthetic peptide"
RVSNRFS

SEQ ID NO: 811 - protein, 7 aa, Artificial Sequence
  source: /note="Description of Artificial Sequence: Synthetic peptide"
KVSNRFS

SEQ ID NO: 812 - protein, 7 aa, Artificial Sequence
  source: /note="Description of Artificial Sequence: Synthetic peptide"
KVSNRFS

SEQ ID NO: 813 - protein, 7 aa, Artificial Sequence
  source: /note="Description of Artificial Sequence: Synthetic peptide"
KVSNRFS

SEQ ID NO: 814 - protein, 7 aa, Artificial Sequence
  source: /note="Description of Artificial Sequence: Synthetic peptide"
KVSNRFS

SEQ ID NO: 815 - protein, 7 aa, Artificial Sequence
  source: /note="Description of Artificial Sequence: Synthetic peptide"
KVSNRFS

SEQ ID NO: 816 - protein, 7 aa, Artificial Sequence
  source: /note="Description of Artificial Sequence: Synthetic peptide"
LASNLES

SEQ ID NO: 817 - protein, 7 aa, Artificial Sequence
  source: /note="Description of Artificial Sequence: Synthetic peptide"
LVSKLDS

SEQ ID NO: 818 - protein, 7 aa, Artificial Sequence
  source: /note="Description of Artificial Sequence: Synthetic peptide"
TVSNRFS

SEQ ID NO: 819 - protein, 7 aa, Artificial Sequence
  source: /note="Description of Artificial Sequence: Synthetic peptide"
FASTRES

SEQ ID NO: 820 - protein, 7 aa, Artificial Sequence
  source: /note="Description of Artificial Sequence: Synthetic peptide"
KVSNRFS

SEQ ID NO: 821 - protein, 7 aa, Artificial Sequence
  source: /note="Description of Artificial Sequence: Synthetic peptide"
KVSNRFS

SEQ ID NO: 822 - protein, 7 aa, Artificial Sequence
  source: /note="Description of Artificial Sequence: Synthetic peptide"
KVSNRFS

SEQ ID NO: 823 - protein, 7 aa, Artificial Sequence
  source: /note="Description of Artificial Sequence: Synthetic peptide"
KVSNRFS

SEQ ID NO: 824 - protein, 7 aa, Artificial Sequence
  source: /note="Description of Artificial Sequence: Synthetic peptide"
TVSNRFS

SEQ ID NO: 825 - protein, 7 aa, Artificial Sequence
  source: /note="Description of Artificial Sequence: Synthetic peptide"
TVSNRFS

SEQ ID NO: 826 - protein, 7 aa, Artificial Sequence
  source: /note="Description of Artificial Sequence: Synthetic peptide"
KVSNRFS

SEQ ID NO: 827 - protein, 7 aa, Artificial Sequence
  source: /note="Description of Artificial Sequence: Synthetic peptide"
KVFNRFS

SEQ ID NO: 828 - protein, 7 aa, Artificial Sequence
  source: /note="Description of Artificial Sequence: Synthetic peptide"
KVSNRFS

SEQ ID NO: 829 - protein, 7 aa, Artificial Sequence
  source: /note="Description of Artificial Sequence: Synthetic peptide"
KVFNRFS

SEQ ID NO: 830 - protein, 7 aa, Artificial Sequence
  source: /note="Description of Artificial Sequence: Synthetic peptide"
KVSNRFS

SEQ ID NO: 831 - protein, 7 aa, Artificial Sequence
  source: /note="Description of Artificial Sequence: Synthetic peptide"
KVFNRFP

SEQ ID NO: 832 - protein, 7 aa, Artificial Sequence
  source: /note="Description of Artificial Sequence: Synthetic peptide"
KVSNRFS

SEQ ID NO: 833 - protein, 7 aa, Artificial Sequence
  source: /note="Description of Artificial Sequence: Synthetic peptide"
AASTLDS

SEQ ID NO: 834 - protein, 7 aa, Artificial Sequence
  source: /note="Description of Artificial Sequence: Synthetic peptide"
KASDLHT

SEQ ID NO: 835 - protein, 7 aa, Artificial Sequence
  source: /note="Description of Artificial Sequence: Synthetic peptide"
KVSNRLS

SEQ ID NO: 836 - protein, 7 aa, Artificial Sequence
  source: /note="Description of Artificial Sequence: Synthetic peptide"
KVSNRFS

SEQ ID NO: 837 - protein, 7 aa, Artificial Sequence
  source: /note="Description of Artificial Sequence: Synthetic peptide"
KVSNRFS

SEQ ID NO: 838 - protein, 7 aa, Artificial Sequence
  source: /note="Description of Artificial Sequence: Synthetic peptide"
LVSKLDS

SEQ ID NO: 839 - protein, 7 aa, Artificial Sequence
  source: /note="Description of Artificial Sequence: Synthetic peptide"
QISRLHS

SEQ ID NO: 840 - protein, 7 aa, Artificial Sequence
  source: /note="Description of Artificial Sequence: Synthetic peptide"
KASNLHT

SEQ ID NO: 841 - protein, 13 aa, Artificial Sequence
  source: /note="Description of Artificial Sequence: Synthetic peptide"
RFLITSTRYVMDY

SEQ ID NO: 842 - protein, 12 aa, Artificial Sequence
  source: /note="Description of Artificial Sequence: Synthetic peptide"
FLITSTRYVMDY

SEQ ID NO: 843 - protein, 14 aa, Artificial Sequence
  source: /note="Description of Artificial Sequence: Synthetic peptide"
ALFYYTGKYQPMDY

SEQ ID NO: 844 - protein, 11 aa, Artificial Sequence
  source: /note="Description of Artificial Sequence: Synthetic peptide"
DGDYVYYAMAY

SEQ ID NO: 845 - protein, 4 aa, Artificial Sequence
  source: /note="Description of Artificial Sequence: Synthetic peptide"
SLGV

SEQ ID NO: 846 - protein, 8 aa, Artificial Sequence
  source: /note="Description of Artificial Sequence: Synthetic peptide"
GLGRLLAY

SEQ ID NO: 847 - protein, 4 aa, Artificial Sequence
  source: /note="Description of Artificial Sequence: Synthetic peptide"
SLGV

SEQ ID NO: 848 - protein, 7 aa, Artificial Sequence
  source: /note="Description of Artificial Sequence: Synthetic peptide"
GMFAMDY

SEQ ID NO: 849 - protein, 3 aa, Artificial Sequence
  source: /note="Description of Artificial Sequence: Synthetic peptide"
EGF

SEQ ID NO: 850 - protein, 12 aa, Artificial Sequence
  source: /note="Description of Artificial Sequence: Synthetic peptide"
VAYYSNFGGFAY

SEQ ID NO: 851 - protein, 14 aa, Artificial Sequence
  source: /note="Description of Artificial Sequence: Synthetic peptide"
PLFVRGQYYITMDY

SEQ ID NO: 852 - protein, 14 aa, Artificial Sequence
  source: /note="Description of Artificial Sequence: Synthetic peptide"
SGGDNYGNPYYFDR

SEQ ID NO: 853 - protein, 10 aa, Artificial Sequence
  source: /note="Description of Artificial Sequence: Synthetic peptide"
NSQLGNAMDY

SEQ ID NO: 854 - protein, 14 aa, Artificial Sequence
  source: /note="Description of Artificial Sequence: Synthetic peptide"
PLLLRWRYFYPVDY

SEQ ID NO: 855 - protein, 14 aa, Artificial Sequence
  source: /note="Description of Artificial Sequence: Synthetic peptide"
PLLVRWRYYITMDY

SEQ ID NO: 856 - protein, 8 aa, Artificial Sequence
  source: /note="Description of Artificial Sequence: Synthetic peptide"
GGYYVFAY

SEQ ID NO: 857 - protein, 10 aa, Artificial Sequence
  source: /note="Description of Artificial Sequence: Synthetic peptide"
NSQLGNAMDY

SEQ ID NO: 858 - protein, 8 aa, Artificial Sequence
  source: /note="Description of Artificial Sequence: Synthetic peptide"
SLTGTKTY

SEQ ID NO: 859 - protein, 7 aa, Artificial Sequence
  source: /note="Description of Artificial Sequence: Synthetic peptide"
GEGDYAY

SEQ ID NO: 860 - protein, 6 aa, Artificial Sequence
  source: /note="Description of Artificial Sequence: Synthetic peptide"
ARATSY

SEQ ID NO: 861 - protein, 8 aa, Artificial Sequence
  source: /note="Description of Artificial Sequence: Synthetic peptide"
WGTTGRSY

SEQ ID NO: 862 - protein, 12 aa, Artificial Sequence
  source: /note="Description of Artificial Sequence: Synthetic peptide"
HGNYYDGSWFAY

SEQ ID NO: 863 - protein, 12 aa, Artificial Sequence
  source: /note="Description of Artificial Sequence: Synthetic peptide"
HGAYYSNPWFAY

SEQ ID NO: 864 - protein, 5 aa, Artificial Sequence
  source: /note="Description of Artificial Sequence: Synthetic peptide"
KSLFY

SEQ ID NO: 865 - protein, 12 aa, Artificial Sequence
  source: /note="Description of Artificial Sequence: Synthetic peptide"
VTGTEGPYYFDY

SEQ ID NO: 866 - protein, 12 aa, Artificial Sequence
  source: /note="Description of Artificial Sequence: Synthetic peptide"
VTGSEGPYYFDY

SEQ ID NO: 867 - protein, 12 aa, Artificial Sequence
  source: /note="Description of Artificial Sequence: Synthetic peptide"
VTGTEGPYYFDY

SEQ ID NO: 868 - protein, 9 aa, Artificial Sequence
  source: /note="Description of Artificial Sequence: Synthetic peptide"
SRYDGYFDY

SEQ ID NO: 869 - protein, 10 aa, Artificial Sequence
  source: /note="Description of Artificial Sequence: Synthetic peptide"
NGRLGNAMDY

SEQ ID NO: 870 - protein, 11 aa, Artificial Sequence
  source: /note="Description of Artificial Sequence: Synthetic peptide"
PYYSHYVPFAY

SEQ ID NO: 871 - protein, 11 aa, Artificial Sequence
  source: /note="Description of Artificial Sequence: Synthetic peptide"
PDNSGYVGFAY

SEQ ID NO: 872 - protein, 11 aa, Artificial Sequence
  source: /note="Description of Artificial Sequence: Synthetic peptide"
PYYSHYVPFAY

SEQ ID NO: 873 - protein, 7 aa, Artificial Sequence
  source: /note="Description of Artificial Sequence: Synthetic peptide"
GLPHFDY

SEQ ID NO: 874 - protein, 10 aa, Artificial Sequence
  source: /note="Description of Artificial Sequence: Synthetic peptide"
NSRYGNSFAY

SEQ ID NO: 875 - protein, 6 aa, Artificial Sequence
  source: /note="Description of Artificial Sequence: Synthetic peptide"
WLPFDY

SEQ ID NO: 876 - protein, 10 aa, Artificial Sequence
  source: /note="Description of Artificial Sequence: Synthetic peptide"
MGYRYPWFAY

SEQ ID NO: 877 - protein, 10 aa, Artificial Sequence
  source: /note="Description of Artificial Sequence: Synthetic peptide"
GGGNYDAMDY

SEQ ID NO: 878 - protein, 16 aa, Artificial Sequence
  source: /note="Description of Artificial Sequence: Synthetic peptide"
VPLPYGSSYGPYFFDF

SEQ ID NO: 879 - protein, 9 aa, Artificial Sequence
  source: /note="Description of Artificial Sequence: Synthetic peptide"
SGDYDGFAY

SEQ ID NO: 880 - protein, 16 aa, Artificial Sequence
  source: /note="Description of Artificial Sequence: Synthetic peptide"
VPLSYGSSYGPYFFDY

SEQ ID NO: 881 - protein, 16 aa, Artificial Sequence
  source: /note="Description of Artificial Sequence: Synthetic peptide"
VPLSYGSGNGPYYFDY

SEQ ID NO: 882 - protein, 16 aa, Artificial Sequence
  source: /note="Description of Artificial Sequence: Synthetic peptide"
VPLSYGGSYGPYFFDF

SEQ ID NO: 883 - protein, 16 aa, Artificial Sequence
  source: /note="Description of Artificial Sequence: Synthetic peptide"
VPLSYGGSYGPYFFDF

SEQ ID NO: 884 - protein, 16 aa, Artificial Sequence
  source: /note="Description of Artificial Sequence: Synthetic peptide"
VPLSYGGSYGPYFFDF

SEQ ID NO: 885 - protein, 7 aa, Artificial Sequence
  source: /note="Description of Artificial Sequence: Synthetic peptide"
GSGPFAY

SEQ ID NO: 886 - protein, 11 aa, Artificial Sequence
  source: /note="Description of Artificial Sequence: Synthetic peptide"
ALDYSNYGFAY

SEQ ID NO: 887 - protein, 7 aa, Artificial Sequence
  source: /note="Description of Artificial Sequence: Synthetic peptide"
GSGPFAY

SEQ ID NO: 888 - protein, 11 aa, Artificial Sequence
  source: /note="Description of Artificial Sequence: Synthetic peptide"
ALDYSNYGFAY

SEQ ID NO: 889 - protein, 7 aa, Artificial Sequence
  source: /note="Description of Artificial Sequence: Synthetic peptide"
GSGPFAY

SEQ ID NO: 890 - protein, 11 aa, Artificial Sequence
  source: /note="Description of Artificial Sequence: Synthetic peptide"
ALDYSNFGFAY

SEQ ID NO: 891 - protein, 7 aa, Artificial Sequence
  source: /note="Description of Artificial Sequence: Synthetic peptide"
GSGPFVY

SEQ ID NO: 892 - protein, 7 aa, Artificial Sequence
  source: /note="Description of Artificial Sequence: Synthetic peptide"
ASIGFDY

SEQ ID NO: 893 - protein, 10 aa, Artificial Sequence
  source: /note="Description of Artificial Sequence: Synthetic peptide"
RLRQTYAMDY

SEQ ID NO: 894 - protein, 7 aa, Artificial Sequence
  source: /note="Description of Artificial Sequence: Synthetic peptide"
ASIGFDY

SEQ ID NO: 895 - protein, 7 aa, Artificial Sequence
  source: /note="Description of Artificial Sequence: Synthetic peptide"
ASIGFDY

SEQ ID NO: 896 - protein, 10 aa, Artificial Sequence
  source: /note="Description of Artificial Sequence: Synthetic peptide"
GYQRFSGFAY

SEQ ID NO: 897 - protein, 5 aa, Artificial Sequence
  source: /note="Description of Artificial Sequence: Synthetic peptide"
SIGDY

SEQ ID NO: 898 - protein, 12 aa, Artificial Sequence
  source: /note="Description of Artificial Sequence: Synthetic peptide"
YGGNYPTYAMDY

SEQ ID NO: 899 - protein, 5 aa, Artificial Sequence
  source: /note="Description of Artificial Sequence: Synthetic peptide"
YDFAY

SEQ ID NO: 900 - protein, 8 aa, Artificial Sequence
  source: /note="Description of Artificial Sequence: Synthetic peptide"
TTGGYFDY

SEQ ID NO: 901 - protein, 11 aa, Artificial Sequence
  source: /note="Description of Artificial Sequence: Synthetic peptide"
TEVKRRRSFAY

SEQ ID NO: 902 - protein, 9 aa, Artificial Sequence
  source: /note="Description of Artificial Sequence: Synthetic peptide"
SQSTLVPPT

SEQ ID NO: 903 - protein, 9 aa, Artificial Sequence
  source: /note="Description of Artificial Sequence: Synthetic peptide"
QQYNSFPLT

SEQ ID NO: 904 - protein, 9 aa, Artificial Sequence
  source: /note="Description of Artificial Sequence: Synthetic peptide"
SQSTHVPPT

SEQ ID NO: 905 - protein, 9 aa, Artificial Sequence
  source: /note="Description of Artificial Sequence: Synthetic peptide"
VQGTHVPYT

SEQ ID NO: 906 - protein, 9 aa, Artificial Sequence
  source: /note="Description of Artificial Sequence: Synthetic peptide"
VQGTHVPYT

SEQ ID NO: 907 - protein, 9 aa, Artificial Sequence
  source: /note="Description of Artificial Sequence: Synthetic peptide"
LQATHFPWT

SEQ ID NO: 908 - protein, 9 aa, Artificial Sequence
  source: /note="Description of Artificial Sequence: Synthetic peptide"
QQYSSSPYT

SEQ ID NO: 909 - protein, 9 aa, Artificial Sequence
  source: /note="Description of Artificial Sequence: Synthetic peptide"
QNDHSHPYT

SEQ ID NO: 910 - protein, 8 aa, Artificial Sequence
  source: /note="Description of Artificial Sequence: Synthetic peptide"
KQSYNLYT

SEQ ID NO: 911 - protein, 9 aa, Artificial Sequence
  source: /note="Description of Artificial Sequence: Synthetic peptide"
QQYNSFPLT

SEQ ID NO: 912 - protein, 9 aa, Artificial Sequence
  source: /note="Description of Artificial Sequence: Synthetic peptide"
SQSTLVPLT

SEQ ID NO: 913 - protein, 8 aa, Artificial Sequence
  source: /note="Description of Artificial Sequence: Synthetic peptide"
NQSYDLLT

SEQ ID NO: 914 - protein, 9 aa, Artificial Sequence
  source: /note="Description of Artificial Sequence: Synthetic peptide"
QQYNSFPLT

SEQ ID NO: 915 - protein, 9 aa, Artificial Sequence
  source: /note="Description of Artificial Sequence: Synthetic peptide"
QQYNSFPLT

SEQ ID NO: 916 - protein, 8 aa, Artificial Sequence
  source: /note="Description of Artificial Sequence: Synthetic peptide"
NQSYDLLT

SEQ ID NO: 917 - protein, 9 aa, Artificial Sequence
  source: /note="Description of Artificial Sequence: Synthetic peptide"
QNGHSFPPT

SEQ ID NO: 918 - protein, 9 aa, Artificial Sequence
  source: /note="Description of Artificial Sequence: Synthetic peptide"
QQYNSFPLT

SEQ ID NO: 919 - protein, 9 aa, Artificial Sequence
  source: /note="Description of Artificial Sequence: Synthetic peptide"
QQYWSTPYT

SEQ ID NO: 920 - protein, 9 aa, Artificial Sequence
  source: /note="Description of Artificial Sequence: Synthetic peptide"
LQATHFPHT

SEQ ID NO: 921 - protein, 9 aa, Artificial Sequence
  source: /note="Description of Artificial Sequence: Synthetic peptide"
LQYASYPWT

SEQ ID NO: 922 - protein, 9 aa, Artificial Sequence
  source: /note="Description of Artificial Sequence: Synthetic peptide"
QQHDEYPWT

SEQ ID NO: 923 - protein, 9 aa, Artificial Sequence
  source: /note="Description of Artificial Sequence: Synthetic peptide"
QQYNSSPWT

SEQ ID NO: 924 - protein, 9 aa, Artificial Sequence
  source: /note="Description of Artificial Sequence: Synthetic peptide"
WQGTHFPWT

SEQ ID NO: 925 - protein, 9 aa, Artificial Sequence
  source: /note="Description of Artificial Sequence: Synthetic peptide"
SQSTLVPLT

SEQ ID NO: 926 - protein, 9 aa, Artificial Sequence
  source: /note="Description of Artificial Sequence: Synthetic peptide"
SQSTLVPLT

SEQ ID NO: 927 - protein, 9 aa, Artificial Sequence
  source: /note="Description of Artificial Sequence: Synthetic peptide"
SQSTLVPLT

SEQ ID NO: 928 - protein, 9 aa, Artificial Sequence
  source: /note="Description of Artificial Sequence: Synthetic peptide"
QQRSSYPPT

SEQ ID NO: 929 - protein, 8 aa, Artificial Sequence
  source: /note="Description of Artificial Sequence: Synthetic peptide"
KQSYNLLT

SEQ ID NO: 930 - protein, 9 aa, Artificial Sequence
  source: /note="Description of Artificial Sequence: Synthetic peptide"
SQSTHVPPT

SEQ ID NO: 931 - protein, 9 aa, Artificial Sequence
  source: /note="Description of Artificial Sequence: Synthetic peptide"
SQSTLVPLT

SEQ ID NO: 932 - protein, 9 aa, Artificial Sequence
  source: /note="Description of Artificial Sequence: Synthetic peptide"
SQSTLVPPT

SEQ ID NO: 933 - protein, 9 aa, Artificial Sequence
  source: /note="Description of Artificial Sequence: Synthetic peptide"
SQSTHVPIT

SEQ ID NO: 934 - protein, 9 aa, Artificial Sequence
  source: /note="Description of Artificial Sequence: Synthetic peptide"
SQSTHVPFT

SEQ ID NO: 935 - protein, 9 aa, Artificial Sequence
  source: /note="Description of Artificial Sequence: Synthetic peptide"
SQSTHVPYT

SEQ ID NO: 936 - protein, 9 aa, Artificial Sequence
  source: /note="Description of Artificial Sequence: Synthetic peptide"
QHNRELPPT

SEQ ID NO: 937 - protein, 9 aa, Artificial Sequence
  source: /note="Description of Artificial Sequence: Synthetic peptide"
VQGTHFPHT

SEQ ID NO: 938 - protein, 9 aa, Artificial Sequence
  source: /note="Description of Artificial Sequence: Synthetic peptide"
SQSTLVPLT

SEQ ID NO: 939 - protein, 9 aa, Artificial Sequence
  source: /note="Description of Artificial Sequence: Synthetic peptide"
QQHYSTPPT

SEQ ID NO: 940 - protein, 9 aa, Artificial Sequence
  source: /note="Description of Artificial Sequence: Synthetic peptide"
SQSTLVPLT

SEQ ID NO: 941 - protein, 9 aa, Artificial Sequence
  source: /note="Description of Artificial Sequence: Synthetic peptide"
SQSTLVPLT

SEQ ID NO: 942 - protein, 9 aa, Artificial Sequence
  source: /note="Description of Artificial Sequence: Synthetic peptide"
SQSTLVPLT

SEQ ID NO: 943 - protein, 9 aa, Artificial Sequence
  source: /note="Description of Artificial Sequence: Synthetic peptide"
SQSTLVPLT

SEQ ID NO: 944 - protein, 9 aa, Artificial Sequence
  source: /note="Description of Artificial Sequence: Synthetic peptide"
SQSTLVPLT

SEQ ID NO: 945 - protein, 9 aa, Artificial Sequence
  source: /note="Description of Artificial Sequence: Synthetic peptide"
SQSTLVPLT

SEQ ID NO: 946 - protein, 9 aa, Artificial Sequence
  source: /note="Description of Artificial Sequence: Synthetic peptide"
SQSTLVPVT

SEQ ID NO: 947 - protein, 9 aa, Artificial Sequence
  source: /note="Description of Artificial Sequence: Synthetic peptide"
AQSTLVPPT

SEQ ID NO: 948 - protein, 9 aa, Artificial Sequence
  source: /note="Description of Artificial Sequence: Synthetic peptide"
SQSTLVPVT

SEQ ID NO: 949 - protein, 9 aa, Artificial Sequence
  source: /note="Description of Artificial Sequence: Synthetic peptide"
AQSTLVPPT

SEQ ID NO: 950 - protein, 9 aa, Artificial Sequence
  source: /note="Description of Artificial Sequence: Synthetic peptide"
SQSTLVPVT

SEQ ID NO: 951 - protein, 9 aa, Artificial Sequence
  source: /note="Description of Artificial Sequence: Synthetic peptide"
AQSTLVPPT

SEQ ID NO: 952 - protein, 9 aa, Artificial Sequence
  source: /note="Description of Artificial Sequence: Synthetic peptide"
SQSTLIPLT

SEQ ID NO: 953 - protein, 9 aa, Artificial Sequence
  source: /note="Description of Artificial Sequence: Synthetic peptide"
LHYANYPPT

SEQ ID NO: 954 - protein, 9 aa, Artificial Sequence
  source: /note="Description of Artificial Sequence: Synthetic peptide"
QQGLSYPLT

SEQ ID NO: 955 - protein, 9 aa, Artificial Sequence
  source: /note="Description of Artificial Sequence: Synthetic peptide"
SQSTHVPYT

SEQ ID NO: 956 - protein, 9 aa, Artificial Sequence
  source: /note="Description of Artificial Sequence: Synthetic peptide"
SQSTHVPWT

SEQ ID NO: 957 - protein, 9 aa, Artificial Sequence
  source: /note="Description of Artificial Sequence: Synthetic peptide"
FQGSHVPPT

SEQ ID NO: 958 - protein, 9 aa, Artificial Sequence
  source: /note="Description of Artificial Sequence: Synthetic peptide"
VQNTHLPYT

SEQ ID NO: 959 - protein, 9 aa, Artificial Sequence
  source: /note="Description of Artificial Sequence: Synthetic peptide"
QQGNSLPPT

SEQ ID NO: 960 - protein, 9 aa, Artificial Sequence
  source: /note="Description of Artificial Sequence: Synthetic peptide"
QQGHSYPLT

SEQ ID NO: 961 - protein, 122 aa, Artificial Sequence; identical to SEQ ID NO: 1
  source: /note="Description of Artificial Sequence: Synthetic polypeptide"

SEQ ID NO: 962 - protein, 121 aa, Artificial Sequence; identical to SEQ ID NO: 2
  source: /note="Description of Artificial Sequence: Synthetic polypeptide"

SEQ ID NO: 963 - protein, 123 aa, Artificial Sequence; identical to SEQ ID NO: 3
  source: /note="Description of Artificial Sequence: Synthetic polypeptide"

SEQ ID NO: 964 - protein, 119 aa, Artificial Sequence; identical to SEQ ID NO: 4
  source: /note="Description of Artificial Sequence: Synthetic polypeptide"

SEQ ID NO: 965 - protein, 113 aa, Artificial Sequence; identical to SEQ ID NO: 5
  source: /note="Description of Artificial Sequence: Synthetic polypeptide"

SEQ ID NO: 966 - protein, 117 aa, Artificial Sequence; identical to SEQ ID NO: 6
  source: /note="Description of Artificial Sequence: Synthetic polypeptide"

SEQ ID NO: 967 - protein, 113 aa, Artificial Sequence; identical to SEQ ID NO: 7
  source: /note="Description of Artificial Sequence: Synthetic polypeptide"

SEQ ID NO: 968 - protein, 116 aa, Artificial Sequence; identical to SEQ ID NO: 8
  source: /note="Description of Artificial Sequence: Synthetic polypeptide"

SEQ ID NO: 969 - protein, 112 aa, Artificial Sequence; identical to SEQ ID NO: 9
  source: /note="Description of Artificial Sequence: Synthetic polypeptide"

SEQ ID NO: 970 - protein, 121 aa, Artificial Sequence; identical to SEQ ID NO: 10
  source: /note="Description of Artificial Sequence: Synthetic polypeptide"

SEQ ID NO: 971 - protein, 123 aa, Artificial Sequence; identical to SEQ ID NO: 11
  source: /note="Description of Artificial Sequence: Synthetic polypeptide"

SEQ ID NO: 972 - protein, 123 aa, Artificial Sequence; identical to SEQ ID NO: 12
  source: /note="Description of Artificial Sequence: Synthetic polypeptide"

SEQ ID NO: 973 - protein, 118 aa, Artificial Sequence; identical to SEQ ID NO: 13
  source: /note="Description of Artificial Sequence: Synthetic polypeptide"

SEQ ID NO: 974 - protein, 123 aa, Artificial Sequence; identical to SEQ ID NO: 14
  source: /note="Description of Artificial Sequence: Synthetic polypeptide"

SEQ ID NO: 975 - protein, 123 aa, Artificial Sequence; identical to SEQ ID NO: 15
  source: /note="Description of Artificial Sequence: Synthetic polypeptide"

SEQ ID NO: 976 - protein, 119 aa, Artificial Sequence; identical to SEQ ID NO: 16
  source: /note="Description of Artificial Sequence: Synthetic polypeptide"

SEQ ID NO: 977 - protein, 118 aa, Artificial Sequence; identical to SEQ ID NO: 17
  source: /note="Description of Artificial Sequence: Synthetic polypeptide"

SEQ ID NO: 978 - protein, 117 aa, Artificial Sequence; identical to SEQ ID NO: 18
  source: /note="Description of Artificial Sequence: Synthetic polypeptide"

SEQ ID NO: 979 - protein, 116 aa, Artificial Sequence; identical to SEQ ID NO: 19
  source: /note="Description of Artificial Sequence: Synthetic polypeptide"

SEQ ID NO: 980 - protein, 115 aa, Artificial Sequence; identical to SEQ ID NO: 20
  source: /note="Description of Artificial Sequence: Synthetic polypeptide"

SEQ ID NO: 981 - protein, 117 aa, Artificial Sequence; identical to SEQ ID NO: 21
  source: /note="Description of Artificial Sequence: Synthetic polypeptide"

SEQ ID NO: 982 - protein, 121 aa, Artificial Sequence; identical to SEQ ID NO: 22
  source: /note="Description of Artificial Sequence: Synthetic polypeptide"

SEQ ID NO: 983 - protein, 120 aa, Artificial Sequence; identical to SEQ ID NO: 23
  source: /note="Description of Artificial Sequence: Synthetic polypeptide"

SEQ ID NO: 984 - protein, 114 aa, Artificial Sequence; identical to SEQ ID NO: 24
  source: /note="Description of Artificial Sequence: Synthetic polypeptide"

SEQ ID NO: 985 - protein, 121 aa, Artificial Sequence; identical to SEQ ID NO: 25
  source: /note="Description of Artificial Sequence: Synthetic polypeptide"

SEQ ID NO: 986 - protein, 121 aa, Artificial Sequence; identical to SEQ ID NO: 26
  source: /note="Description of Artificial Sequence: Synthetic polypeptide"

SEQ ID NO: 987 - protein, 121 aa, Artificial Sequence; identical to SEQ ID NO: 27
  source: /note="Description of Artificial Sequence: Synthetic polypeptide"

SEQ ID NO: 988 - protein, 118 aa, Artificial Sequence; identical to SEQ ID NO: 28
  source: /note="Description of Artificial Sequence: Synthetic polypeptide"

SEQ ID NO: 989 - protein, 118 aa, Artificial Sequence; identical to SEQ ID NO: 29
  source: /note="Description of Artificial Sequence: Synthetic polypeptide"

SEQ ID NO: 990 - protein, 119 aa, Artificial Sequence; identical to SEQ ID NO: 30
  source: /note="Description of Artificial Sequence: Synthetic polypeptide"

SEQ ID NO: 991 - protein, 120 aa, Artificial Sequence; identical to SEQ ID NO: 31
  source: /note="Description of Artificial Sequence: Synthetic polypeptide"

SEQ ID NO: 992 - protein, 119 aa, Artificial Sequence; identical to SEQ ID NO: 32
  source: /note="Description of Artificial Sequence: Synthetic polypeptide"

SEQ ID NO: 993 - protein, 116 aa, Artificial Sequence; identical to SEQ ID NO: 33
  source: /note="Description of Artificial Sequence: Synthetic polypeptide"

SEQ ID NO: 994 - protein, 118 aa, Artificial Sequence; identical to SEQ ID NO: 34
  source: /note="Description of Artificial Sequence: Synthetic polypeptide"

SEQ ID NO: 995 - protein, 115 aa, Artificial Sequence; identical to SEQ ID NO: 35
  source: /note="Description of Artificial Sequence: Synthetic polypeptide"

SEQ ID NO: 996 - protein, 119 aa, Artificial Sequence; identical to SEQ ID NO: 36
  source: /note="Description of Artificial Sequence: Synthetic polypeptide"

SEQ ID NO: 997 - protein, 119 aa, Artificial Sequence; identical to SEQ ID NO: 37
  source: /note="Description of Artificial Sequence: Synthetic polypeptide"

SEQ ID NO: 998 - protein, 125 aa, Artificial Sequence; identical to SEQ ID NO: 38
  source: /note="Description of Artificial Sequence: Synthetic polypeptide"

SEQ ID NO: 999 - protein, 118 aa, Artificial Sequence; identical to SEQ ID NO: 39
  source: /note="Description of Artificial Sequence: Synthetic polypeptide"

SEQ ID NO: 1000 - protein, 125 aa, Artificial Sequence; identical to SEQ ID NO: 40
  source: /note="Description of Artificial Sequence: Synthetic polypeptide"

SEQ ID NO: 1001 - protein, 125 aa, Artificial Sequence; identical to SEQ ID NO: 41
  source: /note="Description of Artificial Sequence: Synthetic polypeptide"

SEQ ID NO: 1002 - protein, 125 aa, Artificial Sequence; identical to SEQ ID NO: 42
  source: /note="Description of Artificial Sequence: Synthetic polypeptide"

SEQ ID NO: 1003 - protein, 125 aa, Artificial Sequence; identical to SEQ ID NO: 43
  source: /note="Description of Artificial Sequence: Synthetic polypeptide"

SEQ ID NO: 1004 - protein, 125 aa, Artificial Sequence; identical to SEQ ID NO: 44
  source: /note="Description of Artificial Sequence: Synthetic polypeptide"

SEQ ID NO: 1005 - protein, 116 aa, Artificial Sequence; identical to SEQ ID NO: 45
  source: /note="Description of Artificial Sequence: Synthetic polypeptide"

SEQ ID NO: 1006 - protein, 119 aa, Artificial Sequence; identical to SEQ ID NO: 46
  source: /note="Description of Artificial Sequence: Synthetic polypeptide"

SEQ ID NO: 1007 - protein, 116 aa, Artificial Sequence; identical to SEQ ID NO: 47
  source: /note="Description of Artificial Sequence: Synthetic polypeptide"

SEQ ID NO: 1008 - protein, 119 aa, Artificial Sequence; identical to SEQ ID NO: 48
  source: /note="Description of Artificial Sequence: Synthetic polypeptide"

SEQ ID NO: 1009 - protein, 116 aa, Artificial Sequence; identical to SEQ ID NO: 49
  source: /note="Description of Artificial Sequence: Synthetic polypeptide"

SEQ ID NO: 1010 - protein, 119 aa, Artificial Sequence; identical to SEQ ID NO: 50
  source: /note="Description of Artificial Sequence: Synthetic polypeptide"

SEQ ID NO: 1011 - protein, 116 aa, Artificial Sequence; identical to SEQ ID NO: 51
  source: /note="Description of Artificial Sequence: Synthetic polypeptide"

SEQ ID NO: 1012 - protein, 116 aa, Artificial Sequence; identical to SEQ ID NO: 52
  source: /note="Description of Artificial Sequence: Synthetic polypeptide"

SEQ ID NO: 1013 - protein, 119 aa, Artificial Sequence; identical to SEQ ID NO: 53
  source: /note="Description of Artificial Sequence: Synthetic polypeptide"

SEQ ID NO: 1014 - protein, 116 aa, Artificial Sequence; identical to SEQ ID NO: 54
  source: /note="Description of Artificial Sequence: Synthetic polypeptide"

SEQ ID NO: 1015 - protein, 116 aa, Artificial Sequence; identical to SEQ ID NO: 55
  source: /note="Description of Artificial Sequence: Synthetic polypeptide"

SEQ ID NO: 1016 - protein, 117 aa, Artificial Sequence; identical to SEQ ID NO: 56
  source: /note="Description of Artificial Sequence: Synthetic polypeptide"

SEQ ID NO: 1017 - protein, 114 aa, Artificial Sequence; identical to SEQ ID NO: 57
  source: /note="Description of Artificial Sequence: Synthetic polypeptide"

SEQ ID NO: 1018 - protein, 121 aa, Artificial Sequence; identical to SEQ ID NO: 58
  source: /note="Description of Artificial Sequence: Synthetic polypeptide"

SEQ ID NO: 1019 - protein, 114 aa, Artificial Sequence; identical to SEQ ID NO: 59
  source: /note="Description of Artificial Sequence: Synthetic polypeptide"

SEQ ID NO: 1020 - protein, 117 aa, Artificial Sequence; identical to SEQ ID NO: 60
  source: /note="Description of Artificial Sequence: Synthetic polypeptide"

SEQ ID NO: 1021 - protein, 120 aa, Artificial Sequence; identical to SEQ ID NO: 61
  source: /note="Description of Artificial Sequence: Synthetic polypeptide"

SEQ ID NO: 1022 - protein, 112 aa, Artificial Sequence; identical to SEQ ID NO: 62
  source: /note="Description of Artificial Sequence: Synthetic polypeptide"

SEQ ID NO: 1023 - protein, 107 aa, Artificial Sequence; identical to SEQ ID NO: 63
  source: /note="Description of Artificial Sequence: Synthetic polypeptide"

SEQ ID NO: 1024 - protein, 112 aa, Artificial Sequence; identical to SEQ ID NO: 64
  source: /note="Description of Artificial Sequence: Synthetic polypeptide"

SEQ ID NO: 1025 - protein, 112 aa, Artificial Sequence; identical to SEQ ID NO: 65
  source: /note="Description of Artificial Sequence: Synthetic polypeptide"

SEQ ID NO: 1026 - protein, 112 aa, Artificial Sequence; identical to SEQ ID NO: 66
  source: /note="Description of Artificial Sequence: Synthetic polypeptide"

SEQ ID NO: 1027 - protein, 112 aa, Artificial Sequence; identical to SEQ ID NO: 67
  source: /note="Description of Artificial Sequence: Synthetic polypeptide"

SEQ ID NO: 1028 - protein, 107 aa, Artificial Sequence; identical to SEQ ID NO: 68
  source: /note="Description of Artificial Sequence: Synthetic polypeptide"

SEQ ID NO: 1029 - protein, 113 aa, Artificial Sequence; identical to SEQ ID NO: 69
  source: /note="Description of Artificial Sequence: Synthetic polypeptide"

SEQ ID NO: 1030 - protein, 112 aa, Artificial Sequence; identical to SEQ ID NO: 70
  source: /note="Description of Artificial Sequence: Synthetic polypeptide"

SEQ ID NO: 1031 - protein, 107 aa, Artificial Sequence; identical to SEQ ID NO: 71
  source: /note="Description of Artificial Sequence: Synthetic polypeptide"

SEQ ID NO: 1032 - protein, 112 aa, Artificial Sequence; identical to SEQ ID NO: 72
  source: /note="Description of Artificial Sequence: Synthetic polypeptide"

SEQ ID NO: 1033 - protein, 112 aa, Artificial Sequence; identical to SEQ ID NO: 73
  source: /note="Description of Artificial Sequence: Synthetic polypeptide"

SEQ ID NO: 1034 - protein, 107 aa, Artificial Sequence; identical to SEQ ID NO: 74
  source: /note="Description of Artificial Sequence: Synthetic polypeptide"

SEQ ID NO: 1035 - protein, 107 aa, Artificial Sequence; identical to SEQ ID NO: 75
  source: /note="Description of Artificial Sequence: Synthetic polypeptide"

SEQ ID NO: 1036 - protein, 112 aa, Artificial Sequence; identical to SEQ ID NO: 76
  source: /note="Description of Artificial Sequence: Synthetic polypeptide"

SEQ ID NO: 1037 - protein, 107 aa, Artificial Sequence; identical to SEQ ID NO: 77
  source: /note="Description of Artificial Sequence: Synthetic polypeptide"

SEQ ID NO: 1038 - protein, 107 aa, Artificial Sequence; identical to SEQ ID NO: 78
  source: /note="Description of Artificial Sequence: Synthetic polypeptide"

SEQ ID NO: 1039 - protein, 107 aa, Artificial Sequence; identical to SEQ ID NO: 79
  source: /note="Description of Artificial Sequence: Synthetic polypeptide"

SEQ ID NO: 1040 - protein, 112 aa, Artificial Sequence; identical to SEQ ID NO: 80
  source: /note="Description of Artificial Sequence: Synthetic polypeptide"

SEQ ID NO: 1041 - protein, 107 aa, Artificial Sequence; identical to SEQ ID NO: 81
  source: /note="Description of Artificial Sequence: Synthetic polypeptide"

SEQ ID NO: 1042 - protein, 107 aa, Artificial Sequence; identical to SEQ ID NO: 82
  source: /note="Description of Artificial Sequence: Synthetic polypeptide"

SEQ ID NO: 1043 - protein, 107 aa, Artificial Sequence; identical to SEQ ID NO: 83
  source: /note="Description of Artificial Sequence: Synthetic polypeptide"

SEQ ID NO: 1044 - protein, 112 aa, Artificial Sequence; identical to SEQ ID NO: 84
  source: /note="Description of Artificial Sequence: Synthetic polypeptide"

SEQ ID NO: 1045 - protein, 112 aa, Artificial Sequence; identical to SEQ ID NO: 85
  source: /note="Description of Artificial Sequence: Synthetic polypeptide"

SEQ ID NO: 1046 - protein, 112 aa, Artificial Sequence; identical to SEQ ID NO: 86
  source: /note="Description of Artificial Sequence: Synthetic polypeptide"

SEQ ID NO: 1047 - protein, 112 aa, Artificial Sequence; identical to SEQ ID NO: 87
  source: /note="Description of Artificial Sequence: Synthetic polypeptide"

SEQ ID NO: 1048 - protein, 106 aa, Artificial Sequence; identical to SEQ ID NO: 88
  source: /note="Description of Artificial Sequence: Synthetic polypeptide"

SEQ ID NO: 1049 - protein, 111 aa, Artificial Sequence; identical to SEQ ID NO: 89
  source: /note="Description of Artificial Sequence: Synthetic polypeptide"

SEQ ID NO: 1050 - protein, 112 aa, Artificial Sequence; identical to SEQ ID NO: 90
  source: /note="Description of Artificial Sequence: Synthetic polypeptide"

SEQ ID NO: 1051 - protein, 112 aa, Artificial Sequence; identical to SEQ ID NO: 91
  source: /note="Description of Artificial Sequence: Synthetic polypeptide"

SEQ ID NO: 1052 - protein, 112 aa, Artificial Sequence; identical to SEQ ID NO: 92
  source: /note="Description of Artificial Sequence: Synthetic polypeptide"

SEQ ID NO: 1053 - protein, 112 aa, Artificial Sequence; identical to SEQ ID NO: 93
  source: /note="Description of Artificial Sequence: Synthetic polypeptide"

SEQ ID NO: 1054 - protein, 112 aa, Artificial Sequence; identical to SEQ ID NO: 94
  source: /note="Description of Artificial Sequence: Synthetic polypeptide"

SEQ ID NO: 1055 - protein, 112 aa, Artificial Sequence; identical to SEQ ID NO: 95
  source: /note="Description of Artificial Sequence: Synthetic polypeptide"

SEQ ID NO: 1056 - protein, 111 aa, Artificial Sequence; identical to SEQ ID NO: 96
  source: /note="Description of Artificial Sequence: Synthetic polypeptide"

SEQ ID NO: 1057 - protein, 112 aa, Artificial Sequence; identical to SEQ ID NO: 97
  source: /note="Description of Artificial Sequence: Synthetic polypeptide"

SEQ ID NO: 1058 - protein, 112 aa, Artificial Sequence; identical to SEQ ID NO: 98
  source: /note="Description of Artificial Sequence: Synthetic polypeptide"

SEQ ID NO: 1059 - protein, 113 aa, Artificial Sequence; identical to SEQ ID NO: 99
  source: /note="Description of Artificial Sequence: Synthetic polypeptide"

SEQ ID NO: 1060 - protein, 112 aa, Artificial Sequence; identical to SEQ ID NO: 100
  source: /note="Description of Artificial Sequence: Synthetic polypeptide"

SEQ ID NO: 1061 - protein, 112 aa, Artificial Sequence; identical to SEQ ID NO: 101
  source: /note="Description of Artificial Sequence: Synthetic polypeptide"

SEQ ID NO: 1062 - protein, 112 aa, Artificial Sequence; identical to SEQ ID NO: 102
  source: /note="Description of Artificial Sequence: Synthetic polypeptide"

SEQ ID NO: 1063 - protein, 112 aa, Artificial Sequence; identical to SEQ ID NO: 103
  source: /note="Description of Artificial Sequence: Synthetic polypeptide"

SEQ ID NO: 1064 - protein, 112 aa, Artificial Sequence; identical to SEQ ID NO: 104
  source: /note="Description of Artificial Sequence: Synthetic polypeptide"

SEQ ID NO: 1065 - protein, 112 aa, Artificial Sequence; identical to SEQ ID NO: 105
  source: /note="Description of Artificial Sequence: Synthetic polypeptide"

SEQ ID NO: 1066 - protein, 112 aa, Artificial Sequence; identical to SEQ ID NO: 106
  source: /note="Description of Artificial Sequence: Synthetic polypeptide"

SEQ ID NO: 1067 - protein, 112 aa, Artificial Sequence; identical to SEQ ID NO: 107
  source: /note="Description of Artificial Sequence: Synthetic polypeptide"

SEQ ID NO: 1068 - protein, 112 aa, Artificial Sequence; identical to SEQ ID NO: 108
  source: /note="Description of Artificial Sequence: Synthetic polypeptide"

SEQ ID NO: 1069 - protein, 112 aa, Artificial Sequence; identical to SEQ ID NO: 109
  source: /note="Description of Artificial Sequence: Synthetic polypeptide"

SEQ ID NO: 1070 - protein, 112 aa, Artificial Sequence; identical to SEQ ID NO: 110
  source: /note="Description of Artificial Sequence: Synthetic polypeptide"

SEQ ID NO: 1071 - protein, 112 aa, Artificial Sequence; identical to SEQ ID NO: 111
  source: /note="Description of Artificial Sequence: Synthetic polypeptide"

SEQ ID NO: 1072 - protein, 111 aa, Artificial Sequence; identical to SEQ ID NO: 112
  source: /note="Description of Artificial Sequence: Synthetic polypeptide"

SEQ ID NO: 1073 - protein, 107 aa, Artificial Sequence; identical to SEQ ID NO: 113
  source: /note="Description of Artificial Sequence: Synthetic polypeptide"

SEQ ID NO: 1074 - protein, 107 aa, Artificial Sequence; identical to SEQ ID NO: 114
  source: /note="Description of Artificial Sequence: Synthetic polypeptide"

SEQ ID NO: 1075 - protein, 112 aa, Artificial Sequence; identical to SEQ ID NO: 115
  source: /note="Description of Artificial Sequence: Synthetic polypeptide"

SEQ ID NO: 1076 - protein, 112 aa, Artificial Sequence; identical to SEQ ID NO: 116
  source: /note="Description of Artificial Sequence: Synthetic polypeptide"

SEQ ID NO: 1077 - protein, 112 aa, Artificial Sequence; identical to SEQ ID NO: 117
  source: /note="Description of Artificial Sequence: Synthetic polypeptide"

SEQ ID NO: 1078 - protein, 112 aa, Artificial Sequence; identical to SEQ ID NO: 118
  source: /note="Description of Artificial Sequence: Synthetic polypeptide"

SEQ ID NO: 1079 - protein, 107 aa, Artificial Sequence; identical to SEQ ID NO: 119
  source: /note="Description of Artificial Sequence: Synthetic polypeptide"

SEQ ID NO: 1080 - protein, 107 aa, Artificial Sequence; identical to SEQ ID NO: 120
  source: /note="Description of Artificial Sequence: Synthetic polypeptide"

SEQ ID NO: 1081 - protein, 5 aa, Artificial Sequence
  source: /note="Description of Artificial Sequence: Synthetic peptide"
SSWMN

SEQ ID NO: 1082 - protein, 5 aa, Artificial Sequence
  source: /note="Description of Artificial Sequence: Synthetic peptide"
SSWMN

SEQ ID NO: 1083 - protein, 5 aa, Artificial Sequence
  source: /note="Description of Artificial Sequence: Synthetic peptide"
DHAIH

SEQ ID NO: 1084 - protein, 5 aa, Artificial Sequence
  source: /note="Description of Artificial Sequence: Synthetic peptide"
SYAIS

SEQ ID NO: 1085 - protein, 5 aa, Artificial Sequence
  source: /note="Description of Artificial Sequence: Synthetic peptide"
RYWMN

SEQ ID NO: 1086 - protein, 5 aa, Artificial Sequence
  source: /note="Description of Artificial Sequence: Synthetic peptide"
TFGMS

SEQ ID NO: 1087 - protein, 5 aa, Artificial Sequence
  source: /note="Description of Artificial Sequence: Synthetic peptide"
SYWMN

SEQ ID NO: 1088 - protein, 5 aa, Artificial Sequence
  source: /note="Description of Artificial Sequence: Synthetic peptide"
SYWMH

SEQ ID NO: 1089 - protein, 5 aa, Artificial Sequence
  source: /note="Description of Artificial Sequence: Synthetic peptide"
SYWLH

SEQ ID NO: 1090 - protein, 5 aa, Artificial Sequence
  source: /note="Description of Artificial Sequence: Synthetic peptide"
SYWMH

SEQ ID NO: 1091 - protein, 5 aa, Artificial Sequence
  source: /note="Description of Artificial Sequence: Synthetic peptide"
DHAIH

SEQ ID NO: 1092 - protein, 5 aa, Artificial Sequence
  source: /note="Description of Artificial Sequence: Synthetic peptide"
NYWMH

SEQ ID NO: 1093 - protein, 5 aa, Artificial Sequence
  source: /note="Description of Artificial Sequence: Synthetic peptide"
SYGVH

SEQ ID NO: 1094 - protein, 5 aa, Artificial Sequence
  source: /note="Description of Artificial Sequence: Synthetic peptide"
DHSIH

SEQ ID NO: 1095 - protein, 5 aa, Artificial Sequence
  source: /note="Description of Artificial Sequence: Synthetic peptide"
DHAIH

SEQ ID NO: 1096 - protein, 5 aa, Artificial Sequence
  source: /note="Description of Artificial Sequence: Synthetic peptide"
DAWMD

SEQ ID NO: 1097 - protein, 5 aa, Artificial Sequence
  source: /note="Description of Artificial Sequence: Synthetic peptide"
SYGVH

SEQ ID NO: 1098 - protein, 5 aa, Artificial Sequence
  source: /note="Description of Artificial Sequence: Synthetic peptide"
SYWMH

SEQ ID NO: 1099 - protein, 5 aa, Artificial Sequence
  source: /note="Description of Artificial Sequence: Synthetic peptide"
DYNMH

SEQ ID NO: 1100 - protein, 5 aa, Artificial Sequence
  source: /note="Description of Artificial Sequence: Synthetic peptide"
KYVIH

SEQ ID NO: 1101 - protein, 5 aa, Artificial Sequence
  source: /note="Description of Artificial Sequence: Synthetic peptide"
SYWIT

SEQ ID NO: 1102 - protein, 5 aa, Artificial Sequence
  source: /note="Description of Artificial Sequence: Synthetic peptide"
EYTIH

SEQ ID NO: 1103 - protein, 5 aa, Artificial Sequence
  source: /note="Description of Artificial Sequence: Synthetic peptide"
NYGMS

SEQ ID NO: 1104 - protein, 5 aa, Artificial Sequence
  source: /note="Description of Artificial Sequence: Synthetic peptide"
TFGMS

SEQ ID NO: 1105 - protein, 5 aa, Artificial Sequence
  source: /note="Description of Artificial Sequence: Synthetic peptide"
SYWMH

SEQ ID NO: 1106 - protein, 5 aa, Artificial Sequence
  source: /note="Description of Artificial Sequence: Synthetic peptide"
SYWIH

SEQ ID NO: 1107 - protein, 5 aa, Artificial Sequence
  source: /note="Description of Artificial Sequence: Synthetic peptide"
SYWIH

SEQ ID NO: 1108 - protein, 5 aa, Artificial Sequence
  source: /note="Description of Artificial Sequence: Synthetic peptide"
AYGMS

SEQ ID NO: 1109 - protein, 5 aa, Artificial Sequence
  source: /note="Description of Artificial Sequence: Synthetic peptide"
NSAVH

SEQ ID NO: 1110 - protein, 5 aa, Artificial Sequence
  source: /note="Description of Artificial Sequence: Synthetic peptide"
SYGVD

SEQ ID NO: 1111 - protein, 5 aa, Artificial Sequence
  source: /note="Description of Artificial Sequence: Synthetic peptide"
SYWMN

SEQ ID NO: 1112 - protein, 5 aa, Artificial Sequence
  source: /note="Description of Artificial Sequence: Synthetic peptide"
SYGVD

SEQ ID NO: 1113 - protein, 5 aa, Artificial Sequence
  source: /note="Description of Artificial Sequence: Synthetic peptide"
RYWMH

SEQ ID NO: 1114 - protein, 5 aa, Artificial Sequence
  source: /note="Description of Artificial Sequence: Synthetic peptide"
TYGVH

SEQ ID NO: 1115 - protein, 6 aa, Artificial Sequence
  source: /note="Description of Artificial Sequence: Synthetic peptide"
SGYSWH

SEQ ID NO: 1116 - protein, 6 aa, Artificial Sequence
  source: /note="Description of Artificial Sequence: Synthetic peptide"
SDYAWN

SEQ ID NO: 1117 - protein, 5 aa, Artificial Sequence
  source: /note="Description of Artificial Sequence: Synthetic peptide"
SYTMS

SEQ ID NO: 1118 - protein, 5 aa, Artificial Sequence
  source: /note="Description of Artificial Sequence: Synthetic peptide"
NYWMH

SEQ ID NO: 1119 - protein, 5 aa, Artificial Sequence
  source: /note="Description of Artificial Sequence: Synthetic peptide"
SYTMH

SEQ ID NO: 1120 - protein, 5 aa, Artificial Sequence
  source: /note="Description of Artificial Sequence: Synthetic peptide"
SYWMH

SEQ ID NO: 1121 - protein, 5 aa, Artificial Sequence
  source: /note="Description of Artificial Sequence: Synthetic peptide"
NYWMH

SEQ ID NO: 1122 - protein, 5 aa, Artificial Sequence
  source: /note="Description of Artificial Sequence: Synthetic peptide"
NHWMH

SEQ ID NO: 1123 - protein, 5 aa, Artificial Sequence
  source: /note="Description of Artificial Sequence: Synthetic peptide"
NHWLH

SEQ ID NO: 1124 - protein, 5 aa, Artificial Sequence
  source: /note="Description of Artificial Sequence: Synthetic peptide"
NYWMH

SEQ ID NO: 1125 - protein, 5 aa, Artificial Sequence
  source: /note="Description of Artificial Sequence: Synthetic peptide"
DYYMD

SEQ ID NO: 1126 - protein, 5 aa, Artificial Sequence
  source: /note="Description of Artificial Sequence: Synthetic peptide"
NYGVD

SEQ ID NO: 1127 - protein, 5 aa, Artificial Sequence
  source: /note="Description of Artificial Sequence: Synthetic peptide"
DYYID

SEQ ID NO: 1128 - protein, 5 aa, Artificial Sequence
  source: /note="Description of Artificial Sequence: Synthetic peptide"
NCGVD

SEQ ID NO: 1129 - protein, 5 aa, Artificial Sequence
  source: /note="Description of Artificial Sequence: Synthetic peptide"
DYYMD

SEQ ID NO: 1130 - protein, 5 aa, Artificial Sequence
  source: /note="Description of Artificial Sequence: Synthetic peptide"
NCGVD

SEQ ID NO: 1131 - protein, 5 aa, Artificial Sequence
  source: /note="Description of Artificial Sequence: Synthetic peptide"
DYYMD

SEQ ID NO: 1132 - protein, 6 aa, Artificial Sequence
  source: /note="Description of Artificial Sequence: Synthetic peptide"
SDSAWN

SEQ ID NO: 1133 - protein, 5 aa, Artificial Sequence
  source: /note="Description of Artificial Sequence: Synthetic peptide"
DSYIH

SEQ ID NO: 1134 - protein, 6 aa, Artificial Sequence
  source: /note="Description of Artificial Sequence: Synthetic peptide"
SDSAWN

SEQ ID NO: 1135 - protein, 6 aa, Artificial Sequence
  source: /note="Description of Artificial Sequence: Synthetic peptide"
SDSAWN

SEQ ID NO: 1136 - protein, 5 aa, Artificial Sequence
  source: /note="Description of Artificial Sequence: Synthetic peptide"
AYAMS

SEQ ID NO: 1137 - protein, 6 aa, Artificial Sequence
  source: /note="Description of Artificial Sequence: Synthetic peptide"
SGYSWH

SEQ ID NO: 1138 - protein, 6 aa, Artificial Sequence
  source: /note="Description of Artificial Sequence: Synthetic peptide"
SDYAWN

SEQ ID NO: 1139 - protein, 6 aa, Artificial Sequence
  source: /note="Description of Artificial Sequence: Synthetic peptide"
DSYSWH

SEQ ID NO: 1140 - protein, 6 aa, Artificial Sequence
  source: /note="Description of Artificial Sequence: Synthetic peptide"
SDYAWN

SEQ ID NO: 1141 - protein, 5 aa, Artificial Sequence
  source: /note="Description of Artificial Sequence: Synthetic peptide"
NFWMN

SEQ ID NO: 1142 - protein, 16 aa, Artificial Sequence
  source: /note="Description of Artificial Sequence: Synthetic peptide"
RSSQSLVHSNGNTYLH

SEQ ID NO: 1143 - protein, 11 aa, Artificial Sequence
  source: /note="Description of Artificial Sequence: Synthetic peptide"
KASQNVGSAVV

SEQ ID NO: 1144 - protein, 16 aa, Artificial Sequence
  source: /note="Description of Artificial Sequence: Synthetic peptide"
RSSQSLVHSNGNTYLH

SEQ ID NO: 1145 - protein, 16 aa, Artificial Sequence
  source: /note="Description of Artificial Sequence: Synthetic peptide"
KSSQSLLHSNGKTYLN

SEQ ID NO: 1146 - protein, 16 aa, Artificial Sequence
  source: /note="Description of Artificial Sequence: Synthetic peptide"
KSSQSLLHSNGKTYLN

SEQ ID NO: 1147 - protein, 16 aa, Artificial Sequence
  source: /note="Description of Artificial Sequence: Synthetic peptide"
KSSQSLLDSDGKTYLN

SEQ ID NO: 1148 - protein, 11 aa, Artificial Sequence
  source: /note="Description of Artificial Sequence: Synthetic peptide"
KASQYVGTYVA

SEQ ID NO: 1149 - protein, 17 aa, Artificial Sequence
  source: /note="Description of Artificial Sequence: Synthetic peptide"
KSSQSLLKSGNQKNYLA

SEQ ID NO: 1150 - protein, 17 aa, Artificial Sequence
  source: /note="Description of Artificial Sequence: Synthetic peptide"
KSSQSLLNSRTRKNYLA

SEQ ID NO: 1151 - protein, 11 aa, Artificial Sequence
  source: /note="Description of Artificial Sequence: Synthetic peptide"
KASQNVGAAVV

SEQ ID NO: 1152 - protein, 16 aa, Artificial Sequence
  source: /note="Description of Artificial Sequence: Synthetic peptide"
RSSQSLVHSNGNTYLH

SEQ ID NO: 1153 - protein, 17 aa, Artificial Sequence
  source: /note="Description of Artificial Sequence: Synthetic peptide"
KSSQSLFNSRTRKNYLA

SEQ ID NO: 1154 - protein, 11 aa, Artificial Sequence
  source: /note="Description of Artificial Sequence: Synthetic peptide"
KASQNVGAAVA

SEQ ID NO: 1155 - protein, 11 aa, Artificial Sequence
  source: /note="Description of Artificial Sequence: Synthetic peptide"
KASQNVGAAVV

SEQ ID NO: 1156 - protein, 17 aa, Artificial Sequence
  source: /note="Description of Artificial Sequence: Synthetic peptide"
KSSQSLLSSRTRKNYLA

SEQ ID NO: 1157 - protein, 11 aa, Artificial Sequence
  source: /note="Description of Artificial Sequence: Synthetic peptide"
RASQSISDYLH

SEQ ID NO: 1158 - protein, 11 aa, Artificial Sequence
  source: /note="Description of Artificial Sequence: Synthetic peptide"
KASQSVGAAVA

SEQ ID NO: 1159 - protein, 11 aa, Artificial Sequence
  source: /note="Description of Artificial Sequence: Synthetic peptide"
KASDHINNWLA

SEQ ID NO: 1160 - protein, 16 aa, Artificial Sequence
  source: /note="Description of Artificial Sequence: Synthetic peptide"
KSSQSLLESDGKTYLN

SEQ ID NO: 1161 - protein, 11 aa, Artificial Sequence
  source: /note="Description of Artificial Sequence: Synthetic peptide"
RASQEIKTYLS

SEQ ID NO: 1162 - protein, 11 aa, Artificial Sequence
  source: /note="Description of Artificial Sequence: Synthetic peptide"
RASKSISKYLA

SEQ ID NO: 1163 - protein, 11 aa, Artificial Sequence
  source: /note="Description of Artificial Sequence: Synthetic peptide"
KASQNVGENVS

SEQ ID NO: 1164 - protein, 16 aa, Artificial Sequence
  source: /note="Description of Artificial Sequence: Synthetic peptide"
RSSRSLLDSDGKTKLH

SEQ ID NO: 1165 - protein, 16 aa, Artificial Sequence
  source: /note="Description of Artificial Sequence: Synthetic peptide"
RSSQSLVHSNGNTYLH

SEQ ID NO: 1166 - protein, 16 aa, Artificial Sequence
  source: /note="Description of Artificial Sequence: Synthetic peptide"
RSSQSLVHSNGNTYLQ

SEQ ID NO: 1167 - protein, 16 aa, Artificial Sequence
  source: /note="Description of Artificial Sequence: Synthetic peptide"
RSSQSLVHSNGNTYLQ

SEQ ID NO: 1168 - protein, 10 aa, Artificial Sequence
  source: /note="Description of Artificial Sequence: Synthetic peptide"
SASSSVSYMH

SEQ ID NO: 1169 - protein, 17 aa, Artificial Sequence
  source: /note="Description of Artificial Sequence: Synthetic peptide"
KSSQSLFSSRTRKNYLA

SEQ ID NO: 1170 - protein, 16 aa, Artificial Sequence
  source: /note="Description of Artificial Sequence: Synthetic peptide"
RSSQSLVHSNGNTYLH

SEQ ID NO: 1171 - protein, 16 aa, Artificial Sequence
  source: /note="Description of Artificial Sequence: Synthetic peptide"
RSSQSLVHSTGNTFLH

SEQ ID NO: 1172 - protein, 16 aa, Artificial Sequence
  source: /note="Description of Artificial Sequence: Synthetic peptide"
RSSQSLVHSNGNTYLH

SEQ ID NO: 1173 - protein, 16 aa, Artificial Sequence
  source: /note="Description of Artificial Sequence: Synthetic peptide"
RSSQSLVHNNGVTYLH

SEQ ID NO: 1174 - protein, 16 aa, Artificial Sequence
  source: /note="Description of Artificial Sequence: Synthetic peptide"
RSSQSLVHSNGNTYLH

SEQ ID NO: 1175 - protein, 16 aa, Artificial Sequence
  source: /note="Description of Artificial Sequence: Synthetic peptide"
RSSQSLVHSNGNTYLH

SEQ ID NO: 1176 - protein, 15 aa, Artificial Sequence
  source: /note="Description of Artificial Sequence: Synthetic peptide"
RASKSVSTSGYSYLH

SEQ ID NO: 1177 - protein, 16 aa, Artificial Sequence
  source: /note="Description of Artificial Sequence: Synthetic peptide"
KSSQSLLYSNGKTYLN

SEQ ID NO: 1178 - protein, 16 aa, Artificial Sequence
  source: /note="Description of Artificial Sequence: Synthetic peptide"
RSSQSLIHSNGNNYLH

SEQ ID NO: 1179 - protein, 17 aa, Artificial Sequence
  source: /note="Description of Artificial Sequence: Synthetic peptide"
KSSQSLLNSSSQKNYLA

SEQ ID NO: 1180 - protein, 16 aa, Artificial Sequence
  source: /note="Description of Artificial Sequence: Synthetic peptide"
RSSQSLIHSNGNNYLH

SEQ ID NO: 1181 - protein, 16 aa, Artificial Sequence
  source: /note="Description of Artificial Sequence: Synthetic peptide"
RSSQSLVHSNGNIYLH

SEQ ID NO: 1182 - protein, 16 aa, Artificial Sequence
  source: /note="Description of Artificial Sequence: Synthetic peptide"
RSSQSLVHSNGNTYLH

SEQ ID NO: 1183 - protein, 16 aa, Artificial Sequence
  source: /note="Description of Artificial Sequence: Synthetic peptide"
RSSQSLIHSNGNNYLH

SEQ ID NO: 1184 - protein, 16 aa, Artificial Sequence
  source: /note="Description of Artificial Sequence: Synthetic peptide"
RSSQSLIHSNGNNYLH

SEQ ID NO: 1185 - protein, 16 aa, Artificial Sequence
  source: /note="Description of Artificial Sequence: Synthetic peptide"
RSSQSLIHSNGNNYLH

SEQ ID NO: 1186 - protein, 16 aa, Artificial Sequence
  source: /note="Description of Artificial Sequence: Synthetic peptide"
RSSQSLVHSSGNTYLH

SEQ ID NO: 1187 - protein, 16 aa, Artificial Sequence
  source: /note="Description of Artificial Sequence: Synthetic peptide"
RSSQRLVHSNGNTYLH

SEQ ID NO: 1188 - protein, 16 aa, Artificial Sequence
  source: /note="Description of Artificial Sequence: Synthetic peptide"
RSSQSLVHSSENTYLH

SEQ ID NO: 1189 - protein, 16 aa, Artificial Sequence
  source: /note="Description of Artificial Sequence: Synthetic peptide"
RSSQSLVHSNGNTYLH

SEQ ID NO: 1190 - protein, 16 aa, Artificial Sequence
  source: /note="Description of Artificial Sequence: Synthetic peptide"
RSSQSLVHSSENTYLH

SEQ ID NO: 1191 - protein, 16 aa, Artificial Sequence
  source: /note="Description of Artificial Sequence: Synthetic peptide"
RSSQSLVHSNGNTYLH

SEQ ID NO: 1192 - protein, 16 aa, Artificial Sequence
  source: /note="Description of Artificial Sequence: Synthetic peptide"
RSSQSLVHSSGNTYLH

SEQ ID NO: 1193 - protein, 11 aa, Artificial Sequence
  source: /note="Description of Artificial Sequence: Synthetic peptide"
RASQEISGYLS

SEQ ID NO: 1194 - protein, 11 aa, Artificial Sequence
  source: /note="Description of Artificial Sequence: Synthetic peptide"
HASQNIYVWLN

SEQ ID NO: 1195 - protein, 16 aa, Artificial Sequence
  source: /note="Description of Artificial Sequence: Synthetic peptide"
RSSQSLVHSNGNTYLN

SEQ ID NO: 1196 - protein, 16 aa, Artificial Sequence
  source: /note="Description of Artificial Sequence: Synthetic peptide"
RSGQSLVHSNGNTYLH

SEQ ID NO: 1197 - protein, 16 aa, Artificial Sequence
  source: /note="Description of Artificial Sequence: Synthetic peptide"
RFSQSIVYSNGNTYLQ

SEQ ID NO: 1198 - protein, 16 aa, Artificial Sequence
  source: /note="Description of Artificial Sequence: Synthetic peptide"
KSSQSLLYSNGKTYLS

SEQ ID NO: 1199 - protein, 11 aa, Artificial Sequence
  source: /note="Description of Artificial Sequence: Synthetic peptide"
RASQDISNYLN

SEQ ID NO: 1200 - protein, 11 aa, Artificial Sequence
  source: /note="Description of Artificial Sequence: Synthetic peptide"
HASQNIDVWLS

SEQ ID NO: 1201 - protein, 17 aa, Artificial Sequence
  source: /note="Description of Artificial Sequence: Synthetic peptide"
RISPGDGDTRYSGKFKG

SEQ ID NO: 1202 - protein, 17 aa, Artificial Sequence
  source: /note="Description of Artificial Sequence: Synthetic peptide"
RISPGDGDTRYSGKFKG

SEQ ID NO: 1203 - protein, 17 aa, Artificial Sequence
  source: /note="Description of Artificial Sequence: Synthetic peptide"
YISPGNGEIKYNEKFKA

SEQ ID NO: 1204 - protein, 16 aa, Artificial Sequence
  source: /note="Description of Artificial Sequence: Synthetic peptide"
VIWTGGGTKYNSALKS

SEQ ID NO: 1205 - protein, 17 aa, Artificial Sequence
  source: /note="Description of Artificial Sequence: Synthetic peptide"
QIYPGDGDTKYNGKFKG

SEQ ID NO: 1206 - protein, 17 aa, Artificial Sequence
  source: /note="Description of Artificial Sequence: Synthetic peptide"
WINTYSGVPTYADDFKG

SEQ ID NO: 1207 - protein, 17 aa, Artificial Sequence
  source: /note="Description of Artificial Sequence: Synthetic peptide"
HIYPGDGDTKYNGKFKG

SEQ ID NO: 1208 - protein, 17 aa, Artificial Sequence
  source: /note="Description of Artificial Sequence: Synthetic peptide"
YINPSSGYTEYNQKFKD

SEQ ID NO: 1209 - protein, 17 aa, Artificial Sequence
  source: /note="Description of Artificial Sequence: Synthetic peptide"
EIDPSDGYSNHNQKFKG

SEQ ID NO: 1210 - protein, 17 aa, Artificial Sequence
  source: /note="Description of Artificial Sequence: Synthetic peptide"
EIDPSDSYTNYNQKFKG

SEQ ID NO: 1211 - protein, 17 aa, Artificial Sequence
  source: /note="Description of Artificial Sequence: Synthetic peptide"
YISPGNGDIKYNDKFKG

SEQ ID NO: 1212 - protein, 17 aa, Artificial Sequence
  source: /note="Description of Artificial Sequence: Synthetic peptide"
YLNPSSGYTKYNQKFKD

SEQ ID NO: 1213 - protein, 16 aa, Artificial Sequence
  source: /note="Description of Artificial Sequence: Synthetic peptide"
VIWRGGSTDYNAAFKS

SEQ ID NO: 1214 - protein, 17 aa, Artificial Sequence
  source: /note="Description of Artificial Sequence: Synthetic peptide"
YISPGNGDIKYDEKFKG

SEQ ID NO: 1215 - protein, 17 aa, Artificial Sequence
  source: /note="Description of Artificial Sequence: Synthetic peptide"
YISPGNGDIKYNEKFKG

SEQ ID NO: 1216 - protein, 19 aa, Artificial Sequence
  source: /note="Description of Artificial Sequence: Synthetic peptide"
EIRNKANNHATYYAESVKG

SEQ ID NO: 1217 - protein, 16 aa, Artificial Sequence
  source: /note="Description of Artificial Sequence: Synthetic peptide"
VIWSGGSTDYNAAFKS

SEQ ID NO: 1218 - protein, 17 aa, Artificial Sequence
  source: /note="Description of Artificial Sequence: Synthetic peptide"
MIHPNSNSTNYNEKFKS

SEQ ID NO: 1219 - protein, 17 aa, Artificial Sequence
  source: /note="Description of Artificial Sequence: Synthetic peptide"
YINPNNGGTSYNQKFKG

SEQ ID NO: 1220 - protein, 17 aa, Artificial Sequence
  source: /note="Description of Artificial Sequence: Synthetic peptide"
YINPYNDGTKYNEKFKG

SEQ ID NO: 1221 - protein, 17 aa, Artificial Sequence
  source: /note="Description of Artificial Sequence: Synthetic peptide"
DIYPGRGTTDYNEKLKS

SEQ ID NO: 1222 - protein, 17 aa, Artificial Sequence
  source: /note="Description of Artificial Sequence: Synthetic peptide"
WFYPGSGSIKYNEKFKD

SEQ ID NO: 1223 - protein, 17 aa, Artificial Sequence
  source: /note="Description of Artificial Sequence: Synthetic peptide"
TITSGGTHTYYPDSVKG

SEQ ID NO: 1224 - protein, 17 aa, Artificial Sequence
  source: /note="Description of Artificial Sequence: Synthetic peptide"
WINTNSGMPTYTDDFRG

SEQ ID NO: 1225 - protein, 17 aa, Artificial Sequence
  source: /note="Description of Artificial Sequence: Synthetic peptide"
YINPRSDYAKYNQKFKD

SEQ ID NO: 1226 - protein, 17 aa, Artificial Sequence
  source: /note="Description of Artificial Sequence: Synthetic peptide"
YINPRGDYTKYNQKFKD

SEQ ID NO: 1227 - protein, 17 aa, Artificial Sequence
  source: /note="Description of Artificial Sequence: Synthetic peptide"
YINPRGDYTKYNQKFKD

SEQ ID NO: 1228 - protein, 17 aa, Artificial Sequence
  source: /note="Description of Artificial Sequence: Synthetic peptide"
WINTYSGVPANADDFKG

SEQ ID NO: 1229 - protein, 16 aa, Artificial Sequence
  source: /note="Description of Artificial Sequence: Synthetic peptide"
VIWSDGSTDYNTAFIS

SEQ ID NO: 1230 - protein, 16 aa, Artificial Sequence
  source: /note="Description of Artificial Sequence: Synthetic peptide"
VIWGVGSTNYNSALKS

SEQ ID NO: 1231 - protein, 17 aa, Artificial Sequence
  source: /note="Description of Artificial Sequence: Synthetic peptide"
YINPSTTSTKYNQKFKD

SEQ ID NO: 1232 - protein, 16 aa, Artificial Sequence
  source: /note="Description of Artificial Sequence: Synthetic peptide"
VIWGVGGTNYNSALKS

SEQ ID NO: 1233 - protein, 17 aa, Artificial Sequence
  source: /note="Description of Artificial Sequence: Synthetic peptide"
YINPSTDYSAYNQKFKD

SEQ ID NO: 1234 - protein, 16 aa, Artificial Sequence
  source: /note="Description of Artificial Sequence: Synthetic peptide"
VIWSDGSTTYNSALKS

SEQ ID NO: 1235 - protein, 16 aa, Artificial Sequence
  source: /note="Description of Artificial Sequence: Synthetic peptide"
YIHYSGSTNYNPSLKS

SEQ ID NO: 1236 - protein, 16 aa, Artificial Sequence
  source: /note="Description of Artificial Sequence: Synthetic peptide"
YINYSGSTSYNPSLRS

SEQ ID NO: 1237 - protein, 17 aa, Artificial Sequence
  source: /note="Description of Artificial Sequence: Synthetic peptide"
TISSGGSYTYYPDSVKG

SEQ ID NO: 1238 - protein, 17 aa, Artificial Sequence
  source: /note="Description of Artificial Sequence: Synthetic peptide"
YINPSSASSKYNQKFKD

SEQ ID NO: 1239 - protein, 17 aa, Artificial Sequence
  source: /note="Description of Artificial Sequence: Synthetic peptide"
YINPSSGYTKYNQKFKD

SEQ ID NO: 1240 - protein, 17 aa, Artificial Sequence
  source: /note="Description of Artificial Sequence: Synthetic peptide"
YINPSSGYTKYNQKFKD

SEQ ID NO: 1241 - protein, 17 aa, Artificial Sequence
  source: /note="Description of Artificial Sequence: Synthetic peptide"
YINPSGDYTKHNQKFKD

SEQ ID NO: 1242 - protein, 17 aa, Artificial Sequence
  source: /note="Description of Artificial Sequence: Synthetic peptide"
YINPINGFNRYNQNFKD

SEQ ID NO: 1243 - protein, 17 aa, Artificial Sequence
  source: /note="Description of Artificial Sequence: Synthetic peptide"
YINPINGFSKYNQNFKN

SEQ ID NO: 1244 - protein, 17 aa, Artificial Sequence
  source: /note="Description of Artificial Sequence: Synthetic peptide"
YINPINGYGKYNQNFKD

SEQ ID NO: 1245 - protein, 17 aa, Artificial Sequence
  source: /note="Description of Artificial Sequence: Synthetic peptide"
YFYPNNGGVKYSQKFKD

SEQ ID NO: 1246 - protein, 16 aa, Artificial Sequence
  source: /note="Description of Artificial Sequence: Synthetic peptide"
VIWGDGITKYNSALKS

SEQ ID NO: 1247 - protein, 17 aa, Artificial Sequence
  source: /note="Description of Artificial Sequence: Synthetic peptide"
YFYPNNGGAKYNQKFKS

SEQ ID NO: 1248 - protein, 16 aa, Artificial Sequence
  source: /note="Description of Artificial Sequence: Synthetic peptide"
VIWGDGLTKYNSALKS

SEQ ID NO: 1249 - protein, 17 aa, Artificial Sequence
  source: /note="Description of Artificial Sequence: Synthetic peptide"
YFYPNNGGAKYNQKFKG

SEQ ID NO: 1250 - protein, 16 aa, Artificial Sequence
  source: /note="Description of Artificial Sequence: Synthetic peptide"
VIWGDGLTKYNSALKS

SEQ ID NO: 1251 - protein, 17 aa, Artificial Sequence
  source: /note="Description of Artificial Sequence: Synthetic peptide"
YFYPNNDGIRYNQRFKG

SEQ ID NO: 1252 - protein, 16 aa, Artificial Sequence
  source: /note="Description of Artificial Sequence: Synthetic peptide"
YISYSGRISYNPSLKS

SEQ ID NO: 1253 - protein, 17 aa, Artificial Sequence
  source: /note="Description of Artificial Sequence: Synthetic peptide"
RIDPTNVNTKYDPKFQG

SEQ ID NO: 1254 - protein, 16 aa, Artificial Sequence
  source: /note="Description of Artificial Sequence: Synthetic peptide"
YISYSGRISYNPSLKS

SEQ ID NO: 1255 - protein, 16 aa, Artificial Sequence
  source: /note="Description of Artificial Sequence: Synthetic peptide"
YISYSGRISYNPSLKS

SEQ ID NO: 1256 - protein, 16 aa, Artificial Sequence
  source: /note="Description of Artificial Sequence: Synthetic peptide"
SISTGGNTYCPDSVKD

SEQ ID NO: 1257 - protein, 16 aa, Artificial Sequence
  source: /note="Description of Artificial Sequence: Synthetic peptide"
YIHNSGSTNYNPSLKS

SEQ ID NO: 1258 - protein, 16 aa, Artificial Sequence
  source: /note="Description of Artificial Sequence: Synthetic peptide"
YISYSGSTSYNPSLKS

SEQ ID NO: 1259 - protein, 16 aa, Artificial Sequence
  source: /note="Description of Artificial Sequence: Synthetic peptide"
YIHYSGRTNYNPSLKT

SEQ ID NO: 1260 - protein, 16 aa, Artificial Sequence
  source: /note="Description of Artificial Sequence: Synthetic peptide"
YISYSGSIRYNPSLKS

SEQ ID NO: 1261 - protein, 17 aa, Artificial Sequence
  source: /note="Description of Artificial Sequence: Synthetic peptide"
QLYPGDDDTHYNGKFKG

SEQ ID NO: 1262 - protein, 7 aa, Artificial Sequence
  source: /note="Description of Artificial Sequence: Synthetic peptide"
KVSNRFS

SEQ ID NO: 1263 - protein, 7 aa, Artificial Sequence
  source: /note="Description of Artificial Sequence: Synthetic peptide"
SSSIRYT

SEQ ID NO: 1264 - protein, 7 aa, Artificial Sequence
  source: /note="Description of Artificial Sequence: Synthetic peptide"
KVSNRFS

SEQ ID NO: 1265 - protein, 7 aa, Artificial Sequence
  source: /note="Description of Artificial Sequence: Synthetic peptide"
LVSKLDS

SEQ ID NO: 1266 - protein, 7 aa, Artificial Sequence
  source: /note="Description of Artificial Sequence: Synthetic peptide"
LVSKLDS

SEQ ID NO: 1267 - protein, 7 aa, Artificial Sequence
  source: /note="Description of Artificial Sequence: Synthetic peptide"
LVSKLDS

SEQ ID NO: 1268 - protein, 7 aa, Artificial Sequence
  source: /note="Description of Artificial Sequence: Synthetic peptide"
SASYRHT

SEQ ID NO: 1269 - protein, 7 aa, Artificial Sequence
  source: /note="Description of Artificial Sequence: Synthetic peptide"
GASTRES

SEQ ID NO: 1270 - protein, 7 aa, Artificial Sequence
  source: /note="Description of Artificial Sequence: Synthetic peptide"
WASTRES

SEQ ID NO: 1271 - protein, 7 aa, Artificial Sequence
  source: /note="Description of Artificial Sequence: Synthetic peptide"
SASYRYS

SEQ ID NO: 1272 - protein, 7 aa, Artificial Sequence
  source: /note="Description of Artificial Sequence: Synthetic peptide"
KVSNRFS

SEQ ID NO: 1273 - protein, 7 aa, Artificial Sequence
  source: /note="Description of Artificial Sequence: Synthetic peptide"
WASTRES

SEQ ID NO: 1274 - protein, 7 aa, Artificial Sequence
  source: /note="Description of Artificial Sequence: Synthetic peptide"
SASIRYT

SEQ ID NO: 1275 - protein, 7 aa, Artificial Sequence
  source: /note="Description of Artificial Sequence: Synthetic peptide"
SASYRYT

SEQ ID NO: 1276 - protein, 7 aa, Artificial Sequence
  source: /note="Description of Artificial Sequence: Synthetic peptide"
WASTRES

SEQ ID NO: 1277 - protein, 7 aa, Artificial Sequence
  source: /note="Description of Artificial Sequence: Synthetic peptide"
YASQSIS

SEQ ID NO: 1278 - protein, 7 aa, Artificial Sequence
  source: /note="Description of Artificial Sequence: Synthetic peptide"
SASIRYA

SEQ ID NO: 1279 - protein, 7 aa, Artificial Sequence
  source: /note="Description of Artificial Sequence: Synthetic peptide"
GATSLET

SEQ ID NO: 1280 - protein, 7 aa, Artificial Sequence
  source: /note="Description of Artificial Sequence: Synthetic peptide"
LVSKLDS

SEQ ID NO: 1281 - protein, 7 aa, Artificial Sequence
  source: /note="Description of Artificial Sequence: Synthetic peptide"
AATTLES

SEQ ID NO: 1282 - protein, 7 aa, Artificial Sequence
  source: /note="Description of Artificial Sequence: Synthetic peptide"
SGSTLQS

SEQ ID NO: 1283 - protein, 7 aa, Artificial Sequence
  source: /note="Description of Artificial Sequence: Synthetic peptide"
SASYRYS

SEQ ID NO: 1284 - protein, 7 aa, Artificial Sequence
  source: /note="Description of Artificial Sequence: Synthetic peptide"
LVSKLDS

SEQ ID NO: 1285 - protein, 7 aa, Artificial Sequence
  source: /note="Description of Artificial Sequence: Synthetic peptide"
KVSNRIS

SEQ ID NO: 1286 - protein, 7 aa, Artificial Sequence
  source: /note="Description of Artificial Sequence: Synthetic peptide"
KVSNRFS

SEQ ID NO: 1287 - protein, 7 aa, Artificial Sequence
  source: /note="Description of Artificial Sequence: Synthetic peptide"
KVSNRFS

SEQ ID NO: 1288 - protein, 7 aa, Artificial Sequence
  source: /note="Description of Artificial Sequence: Synthetic peptide"
STSNLAS

SEQ ID NO: 1289 - protein, 7 aa, Artificial Sequence
  source: /note="Description of Artificial Sequence: Synthetic peptide"
WASTRES

SEQ ID NO: 1290 - protein, 7 aa, Artificial Sequence
  source: /note="Description of Artificial Sequence: Synthetic peptide"
RVSNRFS

SEQ ID NO: 1291 - protein, 7 aa, Artificial Sequence
  source: /note="Description of Artificial Sequence: Synthetic peptide"
KVSNRFS

SEQ ID NO: 1292 - protein, 7 aa, Artificial Sequence
  source: /note="Description of Artificial Sequence: Synthetic peptide"
KVSNRFS

SEQ ID NO: 1293 - protein, 7 aa, Artificial Sequence
  source: /note="Description of Artificial Sequence: Synthetic peptide"
KVSNRFS

SEQ ID NO: 1294 - protein, 7 aa, Artificial Sequence
  source: /note="Description of Artificial Sequence: Synthetic peptide"
KVSNRFS

SEQ ID NO: 1295 - protein, 7 aa, Artificial Sequence
  source: /note="Description of Artificial Sequence: Synthetic peptide"
KVSNRFS

SEQ ID NO: 1296 - protein, 7 aa, Artificial Sequence
  source: /note="Description of Artificial Sequence: Synthetic peptide"
LASNLES

SEQ ID NO: 1297 - protein, 7 aa, Artificial Sequence
  source: /note="Description of Artificial Sequence: Synthetic peptide"
LVSKLDS

SEQ ID NO: 1298 - protein, 7 aa, Artificial Sequence
  source: /note="Description of Artificial Sequence: Synthetic peptide"
TVSNRFS

SEQ ID NO: 1299 - protein, 7 aa, Artificial Sequence
  source: /note="Description of Artificial Sequence: Synthetic peptide"
FASTRES

SEQ ID NO: 1300 - protein, 7 aa, Artificial Sequence
  source: /note="Description of Artificial Sequence: Synthetic peptide"
KVSNRFS

SEQ ID NO: 1301 - protein, 7 aa, Artificial Sequence
  source: /note="Description of Artificial Sequence: Synthetic peptide"
KVSNRFS

SEQ ID NO: 1302 - protein, 7 aa, Artificial Sequence
  source: /note="Description of Artificial Sequence: Synthetic peptide"
KVSNRFS

SEQ ID NO: 1303 - protein, 7 aa, Artificial Sequence
  source: /note="Description of Artificial Sequence: Synthetic peptide"
KVSNRFS

SEQ ID NO: 1304 - protein, 7 aa, Artificial Sequence
  source: /note="Description of Artificial Sequence: Synthetic peptide"
TVSNRFS

SEQ ID NO: 1305 - protein, 7 aa, Artificial Sequence
  source: /note="Description of Artificial Sequence: Synthetic peptide"
TVSNRFS

SEQ ID NO: 1306 - protein, 7 aa, Artificial Sequence
  source: /note="Description of Artificial Sequence: Synthetic peptide"
KVSNRFS

SEQ ID NO: 1307 - protein, 7 aa, Artificial Sequence
  source: /note="Description of Artificial Sequence: Synthetic peptide"
KVFNRFS

SEQ ID NO: 1308 - protein, 7 aa, Artificial Sequence
  source: /note="Description of Artificial Sequence: Synthetic peptide"
KVSNRFS

SEQ ID NO: 1309 - protein, 7 aa, Artificial Sequence
  source: /note="Description of Artificial Sequence: Synthetic peptide"
KVFNRFS

SEQ ID NO: 1310 - protein, 7 aa, Artificial Sequence
  source: /note="Description of Artificial Sequence: Synthetic peptide"
KVSNRFS

SEQ ID NO: 1311 - protein, 7 aa, Artificial Sequence
  source: /note="Description of Artificial Sequence: Synthetic peptide"
KVFNRFP

SEQ ID NO: 1312 - protein, 7 aa, Artificial Sequence
  source: /note="Description of Artificial Sequence: Synthetic peptide"
KVSNRFS

SEQ ID NO: 1313 - protein, 7 aa, Artificial Sequence
  source: /note="Description of Artificial Sequence: Synthetic peptide"
AASTLDS

SEQ ID NO: 1314 - protein, 7 aa, Artificial Sequence
  source: /note="Description of Artificial Sequence: Synthetic peptide"
KASDLHT

SEQ ID NO: 1315 - protein, 7 aa, Artificial Sequence
  source: /note="Description of Artificial Sequence: Synthetic peptide"
KVSNRLS

SEQ ID NO: 1316 - protein, 7 aa, Artificial Sequence
  source: /note="Description of Artificial Sequence: Synthetic peptide"
KVSNRFS

SEQ ID NO: 1317 - protein, 7 aa, Artificial Sequence
  source: /note="Description of Artificial Sequence: Synthetic peptide"
KVSNRFS

SEQ ID NO: 1318 - protein, 7 aa, Artificial Sequence
  source: /note="Description of Artificial Sequence: Synthetic peptide"
LVSKLDS

SEQ ID NO: 1319 - protein, 7 aa, Artificial Sequence
  source: /note="Description of Artificial Sequence: Synthetic peptide"
QISRLHS

SEQ ID NO: 1320 - protein, 7 aa, Artificial Sequence
  source: /note="Description of Artificial Sequence: Synthetic peptide"
KASNLHT

SEQ ID NO: 1321 - protein, 13 aa, Artificial Sequence
  source: /note="Description of Artificial Sequence: Synthetic peptide"
RFLITSTRYVMDY

SEQ ID NO: 1322 - protein, 12 aa, Artificial Sequence
  source: /note="Description of Artificial Sequence: Synthetic peptide"
FLITSTRYVMDY

SEQ ID NO: 1323 - protein, 14 aa, Artificial Sequence
  source: /note="Description of Artificial Sequence: Synthetic peptide"
ALFYYTGKYQPMDY

SEQ ID NO: 1324 - protein, 11 aa, Artificial Sequence
  source: /note="Description of Artificial Sequence: Synthetic peptide"
DGDYVYYAMAY

SEQ ID NO: 1325 - protein, 4 aa, Artificial Sequence
  source: /note="Description of Artificial Sequence: Synthetic peptide"
SLGV

SEQ ID NO: 1326 - protein, 8 aa, Artificial Sequence
  source: /note="Description of Artificial Sequence: Synthetic peptide"
GLGRLLAY

SEQ ID NO: 1327 - protein, 4 aa, Artificial Sequence
  source: /note="Description of Artificial Sequence: Synthetic peptide"
SLGV

SEQ ID NO: 1328 - protein, 7 aa, Artificial Sequence
  source: /note="Description of Artificial Sequence: Synthetic peptide"
GMFAMDY

SEQ ID NO: 1329 - protein, 3 aa, Artificial Sequence
  source: /note="Description of Artificial Sequence: Synthetic peptide"
EGF

SEQ ID NO: 1330 - protein, 12 aa, Artificial Sequence
  source: /note="Description of Artificial Sequence: Synthetic peptide"
VAYYSNFGGFAY

SEQ ID NO: 1331 - protein, 14 aa, Artificial Sequence
  source: /note="Description of Artificial Sequence: Synthetic peptide"
PLFVRGQYYITMDY

SEQ ID NO: 1332 - protein, 14 aa, Artificial Sequence
  source: /note="Description of Artificial Sequence: Synthetic peptide"
SGGDNYGNPYYFDR

SEQ ID NO: 1333 - protein, 10 aa, Artificial Sequence
  source: /note="Description of Artificial Sequence: Synthetic peptide"
NSQLGNAMDY

SEQ ID NO: 1334 - protein, 14 aa, Artificial Sequence
  source: /note="Description of Artificial Sequence: Synthetic peptide"
PLLLRWRYFYPVDY

SEQ ID NO: 1335 - protein, 14 aa, Artificial Sequence
  source: /note="Description of Artificial Sequence: Synthetic peptide"
PLLVRWRYYITMDY

SEQ ID NO: 1336 - protein, 8 aa, Artificial Sequence
  source: /note="Description of Artificial Sequence: Synthetic peptide"
GGYYVFAY

SEQ ID NO: 1337 - protein, 10 aa, Artificial Sequence
  source: /note="Description of Artificial Sequence: Synthetic peptide"
NSQLGNAMDY

SEQ ID NO: 1338 - protein, 8 aa, Artificial Sequence
  source: /note="Description of Artificial Sequence: Synthetic peptide"
SLTGTKTY

SEQ ID NO: 1339 - protein, 7 aa, Artificial Sequence
  source: /note="Description of Artificial Sequence: Synthetic peptide"
GEGDYAY

SEQ ID NO: 1340 - protein, 6 aa, Artificial Sequence
  source: /note="Description of Artificial Sequence: Synthetic peptide"
ARATSY

SEQ ID NO: 1341 - protein, 8 aa, Artificial Sequence
  source: /note="Description of Artificial Sequence: Synthetic peptide"
WGTTGRSY

SEQ ID NO: 1342 - protein, 12 aa, Artificial Sequence
  source: /note="Description of Artificial Sequence: Synthetic peptide"
HGNYYDGSWFAY

SEQ ID NO: 1343 - protein, 12 aa, Artificial Sequence
  source: /note="Description of Artificial Sequence: Synthetic peptide"
HGAYYSNPWFAY

SEQ ID NO: 1344 - protein, 5 aa, Artificial Sequence
  source: /note="Description of Artificial Sequence: Synthetic peptide"
KSLFY

SEQ ID NO: 1345 - protein, 12 aa, Artificial Sequence
  source: /note="Description of Artificial Sequence: Synthetic peptide"
VTGTEGPYYFDY

SEQ ID NO: 1346 - protein, 12 aa, Artificial Sequence
  source: /note="Description of Artificial Sequence: Synthetic peptide"
VTGSEGPYYFDY

SEQ ID NO: 1347 - protein, 12 aa, Artificial Sequence
  source: /note="Description of Artificial Sequence: Synthetic peptide"
VTGTEGPYYFDY

SEQ ID NO: 1348 - protein, 9 aa, Artificial Sequence
  source: /note="Description of Artificial Sequence: Synthetic peptide"
SRYDGYFDY

SEQ ID NO: 1349 - protein, 10 aa, Artificial Sequence
  source: /note="Description of Artificial Sequence: Synthetic peptide"
NGRLGNAMDY

SEQ ID NO: 1350 - protein, 11 aa, Artificial Sequence
  source: /note="Description of Artificial Sequence: Synthetic peptide"
PYYSHYVPFAY

SEQ ID NO: 1351 - protein, 11 aa, Artificial Sequence
  source: /note="Description of Artificial Sequence: Synthetic peptide"
PDNSGYVGFAY

SEQ ID NO: 1352 - protein, 11 aa, Artificial Sequence
  source: /note="Description of Artificial Sequence: Synthetic peptide"
PYYSHYVPFAY

SEQ ID NO: 1353 - protein, 7 aa, Artificial Sequence
  source: /note="Description of Artificial Sequence: Synthetic peptide"
GLPHFDY

SEQ ID NO: 1354 - protein, 10 aa, Artificial Sequence
  source: /note="Description of Artificial Sequence: Synthetic peptide"
NSRYGNSFAY

SEQ ID NO: 1355 - protein, 6 aa, Artificial Sequence
  source: /note="Description of Artificial Sequence: Synthetic peptide"
WLPFDY

SEQ ID NO: 1356 - protein, 10 aa, Artificial Sequence
  source: /note="Description of Artificial Sequence: Synthetic peptide"
MGYRYPWFAY

SEQ ID NO: 1357 - protein, 10 aa, Artificial Sequence
  source: /note="Description of Artificial Sequence: Synthetic peptide"
GGGNYDAMDY

SEQ ID NO: 1358 - protein, 16 aa, Artificial Sequence
  source: /note="Description of Artificial Sequence: Synthetic peptide"
VPLPYGSSYGPYFFDF

SEQ ID NO: 1359 - protein, 9 aa, Artificial Sequence
  source: /note="Description of Artificial Sequence: Synthetic peptide"
SGDYDGFAY

SEQ ID NO: 1360 - protein, 16 aa, Artificial Sequence
  source: /note="Description of Artificial Sequence: Synthetic peptide"
VPLSYGSSYGPYFFDY

SEQ ID NO: 1361 - protein, 16 aa, Artificial Sequence
  source: /note="Description of Artificial Sequence: Synthetic peptide"
VPLSYGSGNGPYYFDY

SEQ ID NO: 1362 - protein, 16 aa, Artificial Sequence
  source: /note="Description of Artificial Sequence: Synthetic peptide"
VPLSYGGSYGPYFFDF

SEQ ID NO: 1363 - protein, 16 aa, Artificial Sequence
  source: /note="Description of Artificial Sequence: Synthetic peptide"
VPLSYGGSYGPYFFDF

SEQ ID NO: 1364 - protein, 16 aa, Artificial Sequence
  source: /note="Description of Artificial Sequence: Synthetic peptide"
VPLSYGGSYGPYFFDF

SEQ ID NO: 1365 - protein, 7 aa, Artificial Sequence
  source: /note="Description of Artificial Sequence: Synthetic peptide"
GSGPFAY

SEQ ID NO: 1366 - protein, 11 aa, Artificial Sequence
  source: /note="Description of Artificial Sequence: Synthetic peptide"
ALDYSNYGFAY

SEQ ID NO: 1367 - protein, 7 aa, Artificial Sequence
  source: /note="Description of Artificial Sequence: Synthetic peptide"
GSGPFAY

SEQ ID NO: 1368 - protein, 11 aa, Artificial Sequence
  source: /note="Description of Artificial Sequence: Synthetic peptide"
ALDYSNYGFAY

SEQ ID NO: 1369 - protein, 7 aa, Artificial Sequence
  source: /note="Description of Artificial Sequence: Synthetic peptide"
GSGPFAY

SEQ ID NO: 1370 - protein, 11 aa, Artificial Sequence
  source: /note="Description of Artificial Sequence: Synthetic peptide"
ALDYSNFGFAY

SEQ ID NO: 1371 - protein, 7 aa, Artificial Sequence
  source: /note="Description of Artificial Sequence: Synthetic peptide"
GSGPFVY

SEQ ID NO: 1372 - protein, 7 aa, Artificial Sequence
  source: /note="Description of Artificial Sequence: Synthetic peptide"
ASIGFDY

SEQ ID NO: 1373 - protein, 10 aa, Artificial Sequence
  source: /note="Description of Artificial Sequence: Synthetic peptide"
RLRQTYAMDY

SEQ ID NO: 1374 - protein, 7 aa, Artificial Sequence
  source: /note="Description of Artificial Sequence: Synthetic peptide"
ASIGFDY

SEQ ID NO: 1375 - protein, 7 aa, Artificial Sequence
  source: /note="Description of Artificial Sequence: Synthetic peptide"
ASIGFDY

SEQ ID NO: 1376 - protein, 10 aa, Artificial Sequence
  source: /note="Description of Artificial Sequence: Synthetic peptide"
GYQRFSGFAY

SEQ ID NO: 1377 - protein, 5 aa, Artificial Sequence
  source: /note="Description of Artificial Sequence: Synthetic peptide"
SIGDY

SEQ ID NO: 1378 - protein, 12 aa, Artificial Sequence
  source: /note="Description of Artificial Sequence: Synthetic peptide"
YGGNYPTYAMDY

SEQ ID NO: 1379 - protein, 5 aa, Artificial Sequence
  source: /note="Description of Artificial Sequence: Synthetic peptide"
YDFAY

SEQ ID NO: 1380 - protein, 8 aa, Artificial Sequence
  source: /note="Description of Artificial Sequence: Synthetic peptide"
TTGGYFDY

SEQ ID NO: 1381 - protein, 11 aa, Artificial Sequence
  source: /note="Description of Artificial Sequence: Synthetic peptide"
TEVKRRRSFAY

SEQ ID NO: 1382 - protein, 9 aa, Artificial Sequence
  source: /note="Description of Artificial Sequence: Synthetic peptide"
SQSTLVPPT

SEQ ID NO: 1383 - protein, 9 aa, Artificial Sequence
  source: /note="Description of Artificial Sequence: Synthetic peptide"
QQYNSFPLT

SEQ ID NO: 1384 - protein, 9 aa, Artificial Sequence
  source: /note="Description of Artificial Sequence: Synthetic peptide"
SQSTHVPPT

SEQ ID NO: 1385 - protein, 9 aa, Artificial Sequence
  source: /note="Description of Artificial Sequence: Synthetic peptide"
VQGTHVPYT

SEQ ID NO: 1386 - protein, 9 aa, Artificial Sequence
  source: /note="Description of Artificial Sequence: Synthetic peptide"
VQGTHVPYT

SEQ ID NO: 1387 - protein, 9 aa, Artificial Sequence
  source: /note="Description of Artificial Sequence: Synthetic peptide"
LQATHFPWT

SEQ ID NO: 1388 - protein, 9 aa, Artificial Sequence
  source: /note="Description of Artificial Sequence: Synthetic peptide"
QQYSSSPYT

SEQ ID NO: 1389 - protein, 9 aa, Artificial Sequence
  source: /note="Description of Artificial Sequence: Synthetic peptide"
QNDHSHPYT

SEQ ID NO: 1390 - protein, 8 aa, Artificial Sequence
  source: /note="Description of Artificial Sequence: Synthetic peptide"
KQSYNLYT

SEQ ID NO: 1391 - protein, 9 aa, Artificial Sequence
  source: /note="Description of Artificial Sequence: Synthetic peptide"
QQYNSFPLT

SEQ ID NO: 1392 - protein, 9 aa, Artificial Sequence
  source: /note="Description of Artificial Sequence: Synthetic peptide"
SQSTLVPLT

SEQ ID NO: 1393 - protein, 8 aa, Artificial Sequence
  source: /note="Description of Artificial Sequence: Synthetic peptide"
NQSYDLLT

SEQ ID NO: 1394 - protein, 9 aa, Artificial Sequence
  source: /note="Description of Artificial Sequence: Synthetic peptide"
QQYNSFPLT

SEQ ID NO: 1395 - protein, 9 aa, Artificial Sequence
  source: /note="Description of Artificial Sequence: Synthetic peptide"
QQYNSFPLT

SEQ ID NO: 1396 - protein, 8 aa, Artificial Sequence
  source: /note="Description of Artificial Sequence: Synthetic peptide"
NQSYDLLT

SEQ ID NO: 1397 - protein, 9 aa, Artificial Sequence
  source: /note="Description of Artificial Sequence: Synthetic peptide"
QNGHSFPPT

SEQ ID NO: 1398 - protein, 9 aa, Artificial Sequence
  source: /note="Description of Artificial Sequence: Synthetic peptide"
QQYNSFPLT

SEQ ID NO: 1399 - protein, 9 aa, Artificial Sequence
  source: /note="Description of Artificial Sequence: Synthetic peptide"
QQYWSTPYT

SEQ ID NO: 1400 - protein, 9 aa, Artificial Sequence
  source: /note="Description of Artificial Sequence: Synthetic peptide"
LQATHFPHT

SEQ ID NO: 1401 - protein, 9 aa, Artificial Sequence
  source: /note="Description of Artificial Sequence: Synthetic peptide"
LQYASYPWT

SEQ ID NO: 1402 - protein, 9 aa, Artificial Sequence
  source: /note="Description of Artificial Sequence: Synthetic peptide"
QQHDEYPWT

SEQ ID NO: 1403 - protein, 9 aa, Artificial Sequence
  source: /note="Description of Artificial Sequence: Synthetic peptide"
QQYNSSPWT

SEQ ID NO: 1404 - protein, 9 aa, Artificial Sequence
  source: /note="Description of Artificial Sequence: Synthetic peptide"
WQGTHFPWT

SEQ ID NO: 1405 - protein, 9 aa, Artificial Sequence
  source: /note="Description of Artificial Sequence: Synthetic peptide"
SQSTLVPLT

SEQ ID NO: 1406 - protein, 9 aa, Artificial Sequence
  source: /note="Description of Artificial Sequence: Synthetic peptide"
SQSTLVPLT

SEQ ID NO: 1407 - protein, 9 aa, Artificial Sequence
  source: /note="Description of Artificial Sequence: Synthetic peptide"
SQSTLVPLT

SEQ ID NO: 1408 - protein, 9 aa, Artificial Sequence
  source: /note="Description of Artificial Sequence: Synthetic peptide"
QQRSSYPPT

SEQ ID NO: 1409 - protein, 8 aa, Artificial Sequence
  source: /note="Description of Artificial Sequence: Synthetic peptide"
KQSYNLLT

SEQ ID NO: 1410 - protein, 9 aa, Artificial Sequence
  source: /note="Description of Artificial Sequence: Synthetic peptide"
SQSTHVPPT

SEQ ID NO: 1411 - protein, 9 aa, Artificial Sequence
  source: /note="Description of Artificial Sequence: Synthetic peptide"
SQSTLVPLT

SEQ ID NO: 1412 - protein, 9 aa, Artificial Sequence
  source: /note="Description of Artificial Sequence: Synthetic peptide"
SQSTLVPPT

SEQ ID NO: 1413 - protein, 9 aa, Artificial Sequence
  source: /note="Description of Artificial Sequence: Synthetic peptide"
SQSTHVPIT

SEQ ID NO: 1414 - protein, 9 aa, Artificial Sequence
  source: /note="Description of Artificial Sequence: Synthetic peptide"
SQSTHVPFT

SEQ ID NO: 1415 - protein, 9 aa, Artificial Sequence
  source: /note="Description of Artificial Sequence: Synthetic peptide"
SQSTHVPYT

SEQ ID NO: 1416 - protein, 9 aa, Artificial Sequence
  source: /note="Description of Artificial Sequence: Synthetic peptide"
QHNRELPPT

SEQ ID NO: 1417 - protein, 9 aa, Artificial Sequence
  source: /note="Description of Artificial Sequence: Synthetic peptide"
VQGTHFPHT

SEQ ID NO: 1418 - protein, 9 aa, Artificial Sequence
  source: /note="Description of Artificial Sequence: Synthetic peptide"
SQSTLVPLT

SEQ ID NO: 1419 - protein, 9 aa, Artificial Sequence
  source: /note="Description of Artificial Sequence: Synthetic peptide"
QQHYSTPPT

SEQ ID NO: 1420 - protein, 9 aa, Artificial Sequence
  source: /note="Description of Artificial Sequence: Synthetic peptide"
SQSTLVPLT

SEQ ID NO: 1421 - protein, 9 aa, Artificial Sequence
  source: /note="Description of Artificial Sequence: Synthetic peptide"
SQSTLVPLT

SEQ ID NO: 1422 - protein, 9 aa, Artificial Sequence
  source: /note="Description of Artificial Sequence: Synthetic peptide"
SQSTLVPLT

SEQ ID NO: 1423 - protein, 9 aa, Artificial Sequence
  source: /note="Description of Artificial Sequence: Synthetic peptide"
SQSTLVPLT

SEQ ID NO: 1424 - protein, 9 aa, Artificial Sequence
  source: /note="Description of Artificial Sequence: Synthetic peptide"
SQSTLVPLT

SEQ ID NO: 1425 - protein, 9 aa, Artificial Sequence
  source: /note="Description of Artificial Sequence: Synthetic peptide"
SQSTLVPLT

SEQ ID NO: 1426 - protein, 9 aa, Artificial Sequence
  source: /note="Description of Artificial Sequence: Synthetic peptide"
SQSTLVPVT

SEQ ID NO: 1427 - protein, 9 aa, Artificial Sequence
  source: /note="Description of Artificial Sequence: Synthetic peptide"
AQSTLVPPT

SEQ ID NO: 1428 - protein, 9 aa, Artificial Sequence
  source: /note="Description of Artificial Sequence: Synthetic peptide"
SQSTLVPVT

SEQ ID NO: 1429 - protein, 9 aa, Artificial Sequence
  source: /note="Description of Artificial Sequence: Synthetic peptide"
AQSTLVPPT

SEQ ID NO: 1430 - protein, 9 aa, Artificial Sequence
  source: /note="Description of Artificial Sequence: Synthetic peptide"
SQSTLVPVT

SEQ ID NO: 1431 - protein, 9 aa, Artificial Sequence
  source: /note="Description of Artificial Sequence: Synthetic peptide"
AQSTLVPPT

SEQ ID NO: 1432 - protein, 9 aa, Artificial Sequence
  source: /note="Description of Artificial Sequence: Synthetic peptide"
SQSTLIPLT

SEQ ID NO: 1433 - protein, 9 aa, Artificial Sequence
  source: /note="Description of Artificial Sequence: Synthetic peptide"
LHYANYPPT

SEQ ID NO: 1434 - protein, 9 aa, Artificial Sequence
  source: /note="Description of Artificial Sequence: Synthetic peptide"
QQGLSYPLT

SEQ ID NO: 1435 - protein, 9 aa, Artificial Sequence
  source: /note="Description of Artificial Sequence: Synthetic peptide"
SQSTHVPYT

SEQ ID NO: 1436 - protein, 9 aa, Artificial Sequence
  source: /note="Description of Artificial Sequence: Synthetic peptide"
SQSTHVPWT

SEQ ID NO: 1437 - protein, 9 aa, Artificial Sequence
  source: /note="Description of Artificial Sequence: Synthetic peptide"
FQGSHVPPT

SEQ ID NO: 1438 - protein, 9 aa, Artificial Sequence
  source: /note="Description of Artificial Sequence: Synthetic peptide"
VQNTHLPYT

SEQ ID NO: 1439 - protein, 9 aa, Artificial Sequence
  source: /note="Description of Artificial Sequence: Synthetic peptide"
QQGNSLPPT

SEQ ID NO: 1440 - protein, 9 aa, Artificial Sequence
  source: /note="Description of Artificial Sequence: Synthetic peptide"
QQGHSYPLT

SEQ ID NO: 1441 - protein, 327 aa, Artificial Sequence
  source: /note="Description of Artificial Sequence: Synthetic polypeptide"
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 1442 - protein, 328 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 1443 - protein, 328 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNIFSCSVMHEALHNHYTQKSLSLSP

SEQ ID NO: 1444 - protein, 323 aa, Artificial Sequence
  source: /note="Description of Artificial Sequence: Synthetic polypeptide"
STKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 1445 - protein, 323 aa, Artificial Sequence
  source: /note="Description of Artificial Sequence: Synthetic polypeptide"
STKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 1446 - protein, 323 aa, Artificial Sequence
  source: /note="Description of Artificial Sequence: Synthetic polypeptide"
STKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 1447 - protein, 323 aa, Artificial Sequence
  source: /note="Description of Artificial Sequence: Synthetic polypeptide"
STKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSP

SEQ ID NO: 1448 - protein, 350 aa, Homo sapiens
MNSFNYTTPDYGHYDDKDTLDLNTPVDKTSNTLRVPDILALVIFAVVFLVGVLGNALVVWVTAFEAKRTINAIWFLNLAVADFLSCLALPILFTSIVQHHHWPFGGAACSILPSLILLNMYASILLLATISADRFLLVFKPIWCQNFRGAGLAWIACAVAWGLALLLTIPSFLYRVVREEYFPPKVLCGVDYSHDKRRERAVAIVRLVLGFLWPLLTLTICYTFILLRTWSRRATRSTKTLKVVVAVVASFFIFWLPYQVTGIMMSFLEPSSPTFLLLNKLDSLCVSFAYINCCINPIIYVVAGQGFQGRLRKSLPSLLRNVLTEESVVRESKSFTRSTVDTMAQKTQAV

SEQ ID NO: 1449 - protein, 37 aa, Homo sapiens
MNSFNYTTPDYGHYDDKDTLDLNTPVDKTSNTLRVPD

SEQ ID NO: 1450 - protein, 26 aa, Homo sapiens
RVVREEYFPPKVLCGVDYSHDKRRER

SEQ ID NO: 1451 - protein, 351 aa, Mus sp.
MDPIDNSSFEINYDHYGTMDPNIPADGIHLPKRQPGDVAALIIYSVVFLVGVPGNALVVWVTAFEARRAVNAIWFLNLAVADLLSCLALPVLFTTVLNHNYWYFDATACIVLPSLILLNMYASILLLATISADRFLLVFKPIWCQKVRGTGLAWMACGVAWVLALLLTIPSFVYREAYKDFYSEHTVCGINYGGGSFPKEKAVAILRLMVGFVLPLLTLNICYTFLLLRTWSRKATRSTKTLKVVMAVVICFFIFWLPYQVTGVMIAWLPPSSPTLKRVEKLNSLCVSLAYINCCVNPIIYVMAGQGFHGRLLRSLPSIIRNALSEDSVGRDSKTFTPSTTDTSTRKSQAV

SEQ ID NO: 1452 - protein, 37 aa, Homo sapiens
MDSFNYTTPDYGHYDDKDTLDLNTPVDKTSNTLRVPD

SEQ ID NO: 1453 - protein, 17 aa, Homo sapiens
TSIVQHHHWPFGGAACS

SEQ ID NO: 1454 - protein, 17 aa, Homo sapiens
SFLEPSSPTFLLLNKLD

SEQ ID NO: 1455 - protein, 17 aa, Homo sapiens
SFLEPSSPTFLLLKKLD

SEQ ID NO: 1456 - protein, 5 aa, Artificial Sequence
  source: /note="Description of Artificial Sequence: Synthetic peptide"
AYAMS

SEQ ID NO: 1457 - protein, 9 aa, Artificial Sequence
  source: /note="Description of Artificial Sequence: Synthetic peptide"
SISTGGNTY

SEQ ID NO: 1458 - protein, 10 aa, Artificial Sequence
  source: /note="Description of Artificial Sequence: Synthetic peptide"
GYQRFSGFAY

SEQ ID NO: 1459 - protein, 16 aa, Artificial Sequence
  source: /note="Description of Artificial Sequence: Synthetic peptide"
RSSQSLVHSNGNTYLN

SEQ ID NO: 1460 - protein, 7 aa, Artificial Sequence
  source: /note="Description of Artificial Sequence: Synthetic peptide"
KVSNRLS

SEQ ID NO: 1461 - protein, 9 aa, Artificial Sequence
  source: /note="Description of Artificial Sequence: Synthetic peptide"
SQSTHVPYT

SEQ ID NO: 1462 - protein, 5 aa, Artificial Sequence
  source: /note="Description of Artificial Sequence: Synthetic peptide"
NYWMH

SEQ ID NO: 1463 - protein, 11 aa, Artificial Sequence
  source: /note="Description of Artificial Sequence: Synthetic peptide"
YLNPSSGYTKY

SEQ ID NO: 1464 - protein, 14 aa, Artificial Sequence
  source: /note="Description of Artificial Sequence: Synthetic peptide"
SGGDNYGNPYYFDR

SEQ ID NO: 1465 - protein, 10 aa, Artificial Sequence
  source: /note="Description of Artificial Sequence: Synthetic peptide"
VHSNGNTYLH

SEQ ID NO: 1466 - protein, 11 aa, Artificial Sequence
  source: /note="Description of Artificial Sequence: Synthetic peptide"
YLNPSSGYTKY

SEQ ID NO: 1467 - protein, 14 aa, Artificial Sequence
  source: /note="Description of Artificial Sequence: Synthetic peptide"
SGGDNYGNPYYFDR

SEQ ID NO: 1468 - protein, 15 aa, Artificial Sequence
  source: /note="Description of Artificial Sequence: Synthetic peptide"
CGREEYFPPKVLGCG

SEQ ID NO: 1469 - protein, 10 aa, Artificial Sequence
  source: /note="Description of Artificial Sequence: Synthetic peptide"
REEYFPPKVL

SEQ ID NO: 1470 - protein, 14 aa, Saimiri sp.
STPDYDYATLDPDI

SEQ ID NO: 1471 - protein, 36 aa, Homo sapiens
MNSFNYTTPDYGHYDDKDTLDLNTPVDKTSNTLRVP

SEQ ID NO: 1472 - protein, 11 aa, Homo sapiens
VQHHHWPFGGA

SEQ ID NO: 1473 - protein, 9 aa, Homo sapiens
SFLEPSSPT

SEQ ID NO: 1474 - protein, 25 aa, Homo sapiens
LYRVVREEYFPPKVLCGVDYSHDKR

SEQ ID NO: 1475 - protein, 5 aa, Unknown
  source: /note="Description of Unknown: DYGHY motif sequence"
DYGHY

The invention claimed is:

1. An antibody molecule capable of binding to complement component 5a receptor 1 (C5aR1), comprising a VH and a VL, wherein the VH comprises:
   i. an HCDR1 comprising an amino acid sequence of SEQ ID NO: 612;
   ii. an HCDR2 comprising an amino acid sequence of SEQ ID NO: 732; and
   iii. an HCDR3 comprising an amino acid sequence of SEQ ID NO: 852; and wherein the VL comprises:
   i. an LCDR1 comprising an amino acid sequence that is identical to or differs by no more than 2 amino acid residues from SEQ ID NO: 672,
   ii. an LCDR2 comprising an amino acid sequence of SEQ ID NO: 792, and
   iii. an LCDR3 comprising an amino acid sequence that is identical to or differs by no more than 2 amino acid residues from SEQ ID NO: 912.

2. A pharmaceutical composition comprising the antibody molecule of claim 1, further comprising a pharmaceutically acceptable carrier or excipient.

3. A combination comprising the antibody molecule of claim 1, and a second therapeutic agent.

4. The antibody molecule of claim 1, comprising a VH and a VL, wherein the VH comprises:
   i. an HCDR1 comprising an amino acid sequence of SEQ ID NO: 612;
   ii. an HCDR2 comprising an amino acid sequence of SEQ ID NO: 732; and
   iii. an HCDR3 comprising an amino acid sequence of SEQ ID NO: 852; and wherein the VL comprises:
   iv. an LCDR1 comprising an amino acid sequence of SEQ ID NO: 672,
   v. an LCDR2 comprising an amino acid sequence of SEQ ID NO: 792, and
   vi. an LCDR3 comprising an amino acid sequence of SEQ ID NO: 912.

* * * * *